US007385023B1

(12) United States Patent
Schultze et al.

(10) Patent No.: US 7,385,023 B1
(45) Date of Patent: Jun. 10, 2008

(54) CANCER IMMUNOTHERAPY AND DIAGNOSIS USING CYTOCHROME P450 1B1

(75) Inventors: Joachim L. Schultze, Brookline, MA (US); Robert H. Vonderheide, Brookline, MA (US); David Sherr, West Roxbury, MA (US); Lee M. Nadler, Newton, MA (US); Britta Maecker, Boston, MA (US); Michael Bergwelt-Baildon, Cambridge, MA (US)

(73) Assignees: Trustees of Boston University, Boston, MA (US); Dana Farber Cancer Institute, Inc., Boston, MA (US)

( * ) Notice: Subject to any disclaimer, the term of this patent is extended or adjusted under 35 U.S.C. 154(b) by 625 days.

(21) Appl. No.: 10/130,413

(22) PCT Filed: Nov. 15, 2000

(86) PCT No.: PCT/US00/31513

§ 371 (c)(1),
(2), (4) Date: Nov. 22, 2002

(87) PCT Pub. No.: WO01/35810

PCT Pub. Date: May 25, 2001

Related U.S. Application Data

(60) Provisional application No. 60/165,590, filed on Nov. 15, 2000.

(51) Int. Cl.
*A61K 38/00* (2006.01)
(52) U.S. Cl. ...................................... 530/300
(58) Field of Classification Search .................. 530/300, 530/350
See application file for complete search history.

(56) References Cited

U.S. PATENT DOCUMENTS 5,399,346 A   3/1995   Anderson et al. ......... 424/93.21

FOREIGN PATENT DOCUMENTS

| WO | WO 97/12236 | 4/1997 |
| WO | WO 97/12246 | 4/1997 |
| WO | WO 00/25813 | 5/2000 |
| WO | WO 00/56773 | 9/2000 |

OTHER PUBLICATIONS

Shimada et al (Archives of Biochemistry and Biophysics, Nov. 1, 1998, 357(1):111-120).*
Sutter et al (Journal of Biological Chemistry, 1994, 269(18):13092-13099.*
Lee et al (J. Immunol., 1999, 163:6292-6300).*
Kirkin et al (1998, APMIS, 106 : 665-679).*
Chaux et al, (Int J Cancer, 1998, 77: 538-542).*
Boon (Adv Can Res, 1992, 58:177-210).*
Celis (J of Clinical Investigation, 2002, 110:1765-1768).*
Gura (Science, 1997, 278:1041-1042.).*
Supplementary European Search Report for EP 00 98 0436, dated Jun. 27, 2005.
Alexander et al. *J. Immunol.*, 159:4753-4761 (1997).
Alexander et al. *Cancer Res.*, 57:4498-4506 (1997).
Altman et al. *Science*, 274:94-96 (1996).
Anderson W. F. *Science*, 226:401-409 (1984).
Angus et al. *Carcinogenesis*, 20(6):947-955 (1999).
Ashley et al. *J. Exp. Med.*, 186(7):1177-1182 (1997).
Baron et al. *Biochem. Pharmacol.*, 56:1105-1110 (1998).
Blömer et al. *J. Virol.*, 71(9):6641-6649 (1997).
Boczkowski et al. *J. Exp. Med.*, 184:465-472 (1996).
Boon et al. *Ann. Rev. Immunol.*, 12:337-365 (1994).
Bowes III et al. *Biochem. Pharmacol.*, 52(4):587-595 (1996).
Brigham et al. *Am. J. Med. Sci.*, 298(4):278-281 (1989).
Brossart et al. *Blood*, 93(12);4309-4317 (1999).
Brusic et al. *Bioinformatics*, 14(2):121-130 (1998).
Brusic et al. *Nucl. Acids Res.*, 26(1):368-371 (1998).
Busch et al. *J. Immunol.*, 160:4441-4448 (1998).
Buters et al. *Proc. Natl. Acad. Sci. USA*, 96:1977-1982 (1999).
Cayouette et al. *Hum. Gene Therapy.*, 8(4):423-430 (1997).
Cheung et al. *Cancer Lett.*, 139(2):199-205 (1999).
Cornetta et al. *Nucl. Acid Res. Mol. Biol.*, 36:311-322 (1989).
Dassi et al. *Clin. Chem.*, 44(12):2416-2421 (1998).
Dunbar et al. *Curr. Biol.*, 8(7):413-416 (1998).
Edwards et al. *Biochem. Pharmacol.*, 56(3):377-387 (1998).
Eglitis et al. *BioTechniques*, 6(7):608-614 (1988).
Eltom et al. *Carcinogenesis*, 19(8):1437-1444 (1998).
Engelhard V. H. *Annu. Rev. Immunol.*, 12:181-207 (1994).
Felgner et al. *Proc. Natl. Acad. Sci. USA*, 84:7413-7417 (1987).
Feltkamp et al. *Mol. Immunol.*, 31(18):1391-1401 (1994).
Friedmann T. *Science*, 244:1275-1281 (1989).
Gallimore et al. *Eur. J. Immunol.*, 28(10):3301-3311 (1998).
Genbank Accession No. U56438 (1996).
Gulukota et al. *J. Mol. Biol.*, 267(5):1258-1267 (1997).
Hakkola et al. *Carcinogenesis*, 18(2):391-397 (1997).
Hammer et al. *J. Exp. Med.*, 180:2353-2358 (1994).
Hammer J. *Curr. Opin. Immunol.*, 7(2):263-269 (1995).
Hayes et al. *Proc. Natl. Acad. Sci. USA*, 93:9776-9781 (1996).
Heidel et al. *Mol. Pharmacol.*, 54:1000-10006 (1998).
Herr et al. *J. Immunol. Methods*, 203(2):141-152 (1997).
Johnson L. C. *Chest*, 107(2):77S-83S (1995).
Kammer et al. *J. Exp. Med.*, 190(2):169-176 (1999).
Kido et al. *Curr. Eye Res.*, 15(8):833-844 (1996).
Kress et al. *Cancer Res.*, 57:1264-1269 (1997).
Lee et al. *Nat. Med.*, 5(6):677-685 (1999).
La Salle et al. *Science*, 259-988-990 (1993).
Madden D. R. *Annu. Rev. Immunol.*, 13:587-622 (1995).
Man et al. *Int'l Immunol.*, 7(4):597-605 (1995).
McMichael et al. *J. Exp. Med.*, 187(9):1367-1371 (1998).
Miller et al. *Biotechniques*, 7(9):980-990 (1989).
Miller A. D. *Human Gene Therapy*, 1:5-14 (1990).
Miyoshi et al. *Proc. Natl. Acad. Sci. USA*, 94:10319-10323 (1997).
Moen R. C. *Blood Cells*, 17(2):407-416 (1991).

(Continued)

*Primary Examiner*—Misook Yu
*Assistant Examiner*—Sean E Aeder
(74) *Attorney, Agent, or Firm*—Ivor R. Elrifi; Cynthia Kozakiewicz; Mintz, Levin

(57) ABSTRACT

The invention provides methods for conducting cancer immunotherapy and diagnosis using cytochrome P450 1B1 and peptide fragments thereof.

1 Claim, 18 Drawing Sheets

OTHER PUBLICATIONS

Molldrem et al. *Blood*, 88(7):2450-2457 (1996).
Molldrem et al. *Cancer Res.*, 59:2675-2681 (1999).
Murray et al. *Cancer Res.*, 57(14):3026-3031 (1997).
Naldini et al. *Science*, 272:263-267 (1996).
Nijman et al. *Eur. J. Immunol.*, 23(6):1215-1219 (1993).
Ono et al. *Neurosci. Lett.*, 117(3):259-263 (1990).
Pamer et al. *Annu. Rev. Immunol.*, 16:323-358 (1998).
Parker et al. *J. Immunol.*, 152:163-175 (1994).
Parker et al. *Immunol Res.*, 14:34-57 (1995).
Porgador et al. *Immunity*, 6(6):715-726 (1997).
Rammensee et al. *Annu. Rev. Immunol.*, 11:213-244 (1993).
Rammensee et al. *Immunogenetics*, 41(4):178-228 (1995).
Rock et al. *Annu. Rev. Immunol.*, 17:739-779 (1999).
Romero et al. *J. Exp. Med.*, 188(9):1641-1650 (1998).
Rosenberg et al. *N. Engl. J. Med.*, 323(9);570-578 (1990).
Rosenberg S. A. *Immunol. Today*, 18(40:175-182(1997).
Rosenberg et al. *Nat. Med.*, 4(3):321-327 (1998).
Rosenberg S. A. *Immunity*, 10(3):281-287 (1999).
Rothbard et al. *Annu Rev. Immunol.*, 9:527-565 (1991).
Ruppert et al. *Cell*, 74(5):929-937 (1993).
Sahin et al. *Curr. Opin. Immunol.*, 9(5):709-716 (1997).
Salter et al. *EMBO J.*, 5(5):943-949 (1986).
Sarma et al. *J. Exp. Med.*, 189(5):811-820 (1999).
Savage et al. *Immunity*, 10(4):485-492 (1999).
Schönbach et al. *J. Immunol*, 154:5951-5958 (1995).
Schultze et al. *J. Clin. Invest.*, 100(11):2757-2765 (1997).
Schultze et al. *J. Exp. Med.*, 189(1):1-11 (1999).
Schumacher et al. *Cell*, 62(3):563-567 (1990).
Sette et al. *J. Immunol.*, 153:5586-5592 (1994).
Sharp D. *The Lancet*, 337:1277-1278 (1991).
Sidney et al. *Immunol. Today*, 17(6):261-266 (1996).
Spencer et al. *Cancer Epidemiol Biomarkers Prev.*, 8(2):139-146 (1999).
Spink et al. *Carcinogenesis*, 19(2):291-298 (1998).
Straubinger et al. *Meth. Enzimol.*, 101:512-527 (1983).
Sutter et al. *J. Biol. Chem.*, 269(18):13092-13099 (1994).
Tang et al. *J. Biol. Chem.*, 271(45):28324-28330 (1996).
Tolstoshev et al. *Curr. Opin. Biotech.*, 1:55-61 (1990).
Townsend et al. *Cell*, 62(2):285-295 (1990).
Valmori et al. *Cancer Res.*, 59:2167-2173 (1999).
Van Den Eynde et al. *Curr. Opin. Immunol.*, 9(5):684-693 (1997).
Van der Burg et al. *J. Immunol.*, 156:3308-3314 (1996).
Van Pel et al. *Immunol. Rev.*, 145:229-250 (1995).
Vonderheide et al. *Immunity*, 10(6):673-679 (1999).
Wentworth et al. *Int'l Immunol.*, 8(5):651-659 (1996).
Wolff et al. *Science*, 247:1465-1468 (1990).
Wu et al. *J. Biol. Chem.*, 263(29):14621-14624 (1988).
Wu et al. *J. Biol. Chem.*, 264(29):16985-16987 (1989).
Yee et al. *J. Immunol.*, 162:2227-2234 (1999).

\* cited by examiner

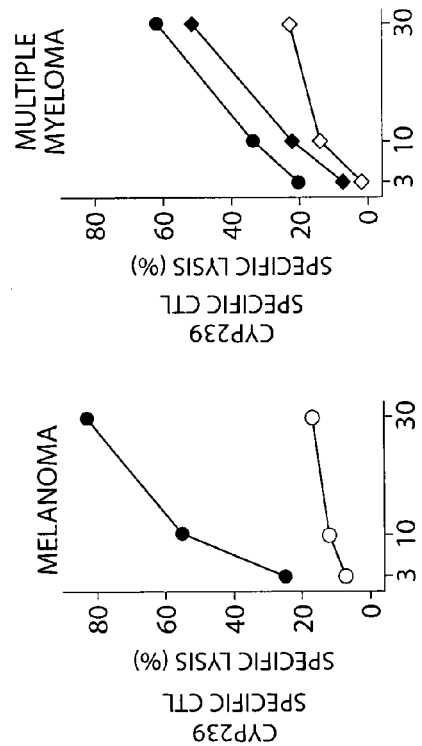
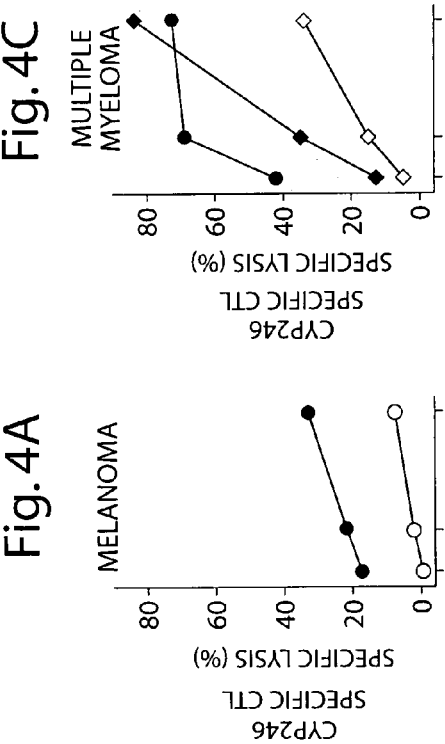
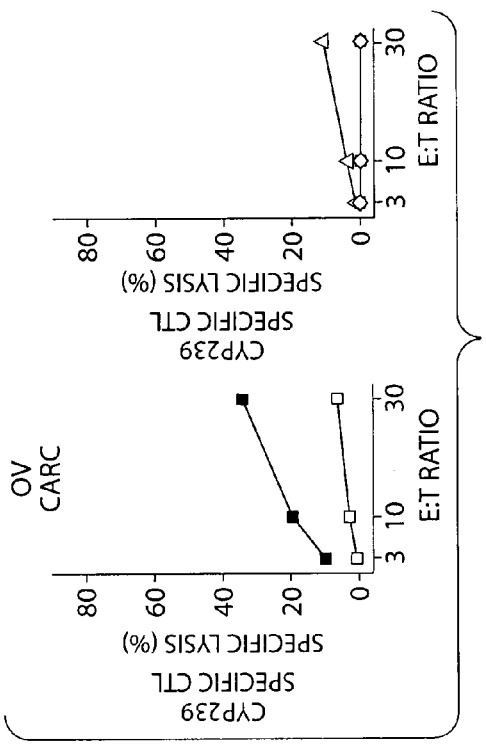
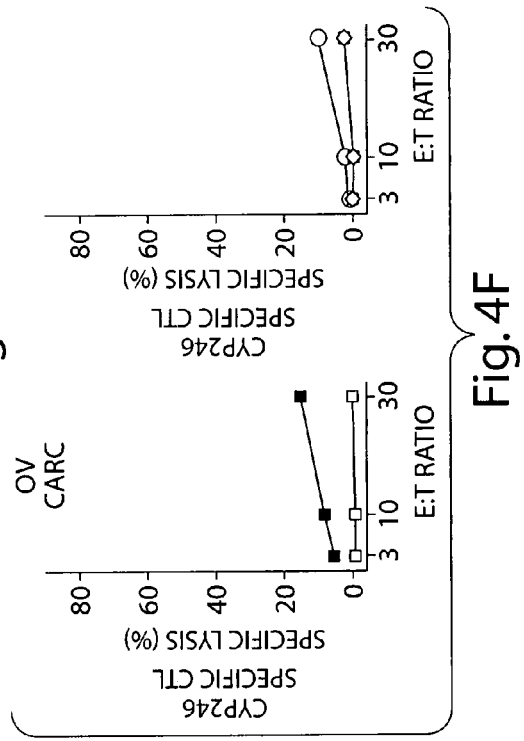
Fig. 4A Fig. 4B Fig. 4C Fig. 4D Fig. 4E Fig. 4F

CANCER IMMUNOTHERAPY AND DIAGNOSIS USING CYTOCHROME P450 1B1

This application is U.S. national stage application, filed under 35 U.S.C. §371, of PCT International Application No. PCT/US00/31513 filed Nov. 15, 2000, which claims priority to provisional application 60/165,590, filed Nov. 15, 1999, now expired.

BACKGROUND OF THE INVENTION

This invention relates to the prevention, treatment, and diagnosis of cancer.

The paucity of clinically significant anti-tumor immune responses in cancer patients has long suggested that antigen-specific immunotherapy would not play a significant role in cancer treatment. However, pioneering studies in the early 1990s, using tumor-specific cytotoxic T lymphocytes (CTLs) from cancer patients, showed the existence of human tumor associated antigens (TAAs). This led to the suggestion that such antigens could be used to stimulate therapeutic anti-tumor immune responses in patients. Although these studies focused primarily on melanoma, TAAs have also been characterized in several other malignancies (Van Pel et al., Immunological Reviews 145:229-250, 1995; Rosenberg, Immunol. Today 18:175-182, 1997; Van den Eynde et al., Curr. Opin. Immunol. 9:684-693, 1997), raising the hypothesis that most, if not all, tumors express antigens that can be used to induce CTL-mediated tumor destruction. Consequently, clinical efforts are now underway to target TAAs in strategies, such as vaccination and adoptive T cell therapy, to generate effective anti-tumor CTL responses in patients.

The demonstration that TAA-specific immune responses can lead to tumor regression has been borne out extensively in animal models (Rosenberg, Immunity 10:281-287, 1999). Although the identification of TAAs using patients' CTLs has revitalized the field of T cell immunotherapy, these methods are slow, very expensive, and labor-intensive. Moreover, the strategy relies on the generation of tumor-specific T cell clones in vitro, suggesting that only a restricted set of TAAs will be identified by this method. With these limitations in mind, Pfreundschuh and colleagues developed an alternative approach, SEREX (serological identification of antigens by recombinant expression cloning), to identify TAAs (Sahin et al., Curr. Opin. Immunol. 9:709-716, 1997). SEREX makes use of patients' antibody responses to tumor-derived genes and this strategy has accelerated the identification of TAAs significantly. Although several T cell-defined TAAs, such as the MAGE genes, have also been identified by SEREX, there is no information available about CTL epitopes for the vast majority of genes in the SEREX database, and, of course, such epitopes are required to activate a CTL response.

Although there is no doubt that the identification of numerous TAAs by CTL-based approaches or SEREX reflects the existence of an anti-tumor immune response, it remains to be determined if these antigens play a role as tumor regression antigens (Sarma et al., J. Exp. Med. 189:811-820, 1999). Indeed, most T cell epitopes in TAAs identified by patient CTLs have been demonstrated to be of low MHC binding affinity and/or low MHC/peptide complex stability. This quality distinguishes TAA-derived peptides from viral peptides that are almost exclusively of high binding affinity and high MHC/peptide complex stability (Feltkamp et al. Mol. Immunol. 31:1391-1401, 1994; Sette et al., J. Immunol. 153: 5586-5592, 1994). Clinical vaccination trials have circumvented this obstacle by utilizing altered peptides with higher MHC binding affinity and higher MHC/peptide complex stability (Rosenberg et al., Nat. Med. 4:321-327, 1998). The low binding affinity of TAA-derived peptides is likely to be one of the reasons why natural CTL responses against such peptides are not successful for tumor eradication. This is in agreement with the finding that large numbers of TAA-specific CTLs co-exist with metastatic tumors in melanoma patients (Romero et al., J. Exp. Med. 188:1641-1650, 1998). A recent study has even demonstrated that despite expansion, such CTLs were hyporesponsive, showing reduced cytotoxic and cytokine responses (Lee et al., Nat. Med. 5:677-685, 1999).

In addition, most TAAs described thus far are expressed in only one or a few tumor types, and not all patients with a given tumor type express the associated TAA. As a result, progress in the field of cancer immunotherapy has been relatively slow, because it has not been possible to develop widely useful TAA-specific immunotherapeutic strategies. Not only has it been necessary to tailor such therapies to individual types of malignancies, in some cases (such as the immunoglobulin idiotypic antigen in B cell malignancies), it has been necessary to tailor these therapies to individual patients.

SUMMARY OF THE INVENTION

The invention provides a method of treating a patient that has or is at risk of having a cell that expresses cytochrome P450 1B1 (CYP1B1). This method involves administering to the patient a cytotoxic T lymphocyte (CTL)(autologous or allogeneic) that leads to death of (from here on said as kill) the cell in a CYP1B1-specific, major histocompatibility complex-restricted fashion. The CTL can be generated, for example, by activation with an antigen presenting cell that has been pulsed with CYP1B1, or a peptide of CYP1B1 that binds to a major histocompatibility complex molecule.

The invention also includes a second method of treating a patient that has or is at risk of having a cell that expresses CYP1B1. This method involves administering to the patient an antigen presenting cell (APC) that activates in the patient a cytotoxic T lymphocyte that kills the cell in a CYP1B1-specific, major histocompatibility complex-restricted fashion. The APC can be pulsed with CYP1B1 or a peptide of CYP1B1 that binds to a major histocompatibility complex molecule.

Another method included in the invention is a third method of treating a patient that has or is at risk of having a cell that expresses CYP1B1. This method involves administering to the patient CYP1B1 or a peptide of CYP1B1 that binds to a major histocompatibility complex molecule, which is processed by an antigen presenting cell in the patient, which, in turn, activates a cytotoxic T lymphocyte in the patient to induce cell death of the cell that expresses CYP1B1 in a CYP1B1-specific, major histocompatibility complex-restricted fashion. The CYP1B1 polypeptide or peptide of CYP1B1 used in this method can be administered to the patient in association with an adjuvant.

The invention also includes a fourth method of treating a patient that has or is at risk of having a cell that expresses CYP1B1. This method involves administering to the patient a nucleic acid molecule encoding CYP1B1 or a peptide of CYP1B1 that binds to a major histocompatibility complex molecule. The nucleic acid molecule is expressed in the patient so that it can be processed by an antigen presenting cell in the patient, which activates a cytotoxic T lymphocyte in the patient to induce cell death of the cell that expresses CYP1B1, in a CYP1B1-specific, major histocompatibility complex-restricted fashion. The nucleic acid molecule encoding CYP1B1 or a peptide of CYP1B1 can be present in an expression vector.

Each of the methods described above can also include treatment based around a second (or more) tumor associated antigen, e.g., telomerase (hTERT, PCT/US99/25438), or a peptide thereof that binds to MHC (e.g., the I540 peptide).

In any of the methods described above, the patient can have a tumor containing cells that express CYP1B1. APCs used in these methods can be, for example, a dendritic cell or a CD40-activated B cell. The peptide of CYP1B1 in these methods can bind to a class I or a class II major histocompatibility complex (MHC) molecule. In the case of a class I MHC molecule, the molecule can be, for example, an HLA-A2 molecule, and the peptide of CYP1B1 can include the amino acid sequence of CYP239 (SEQ ID NO:1; SLVDVMPWL), CYP246 (SEQ ID NO:2; WLQYFPNPI), CYP190 (SEQ ID NO:3; FLDPRPLTV), or CYP528 (SEQ ID NO:4; LLDSAVQNL). Examples of other CYP1B1 sequences that can be used in these methods are set forth in the Sequence Appendix and in Tables 3-10.

The invention also includes a method of assessing the level of immunity of a patient to CYP1B1 or a peptide of CYP1B1 that binds to a major histocompatibility complex molecule. In this method, the level of cytotoxic T lymphocytes specific for CYP1B1 or a peptide of CYP1B1 is measured in a sample from a patient. The sample can be obtained from the patient before, during, or after a cancer treatment is administered to the patient. A sample can also be obtained, for example, before and after treatment.

The invention also includes CYP1B1 peptides that bind to major histocompatibility complex molecules, for example, a peptide that consists essentially of the amino acid sequence set forth in SEQ ID NO:1 (CYP239), SEQ ID NO:2 (CYP246), SEQ ID NO:3 (CYP190), or SEQ ID NO:4 (CYP528).

Also included in the invention is an ex vivo generated cytotoxic T lymphocyte that specifically kills a cell expressing CYP1B1 in a specific, major histocompatibility complex-restricted fashion, and an ex vivo generated antigen presenting cell (e.g., a dendritic cell or a CD40-activated B cell) that presents a peptide of CYP1B1 in the context of a major histocompatibility complex molecule.

As is understood in the art, a "polypeptide" is a chain of amino acids linked to one another by peptide bonds. A "protein" can be made up of one or more polypeptides, while a "peptide" is generally understood to be (or include) a fragment of a polypeptide, and to consist of a chain of peptide bond-linked amino acids that is shorter in length than a full length polypeptide from which it may be derived.

A "tumor associated antigen," such as CYP1B1, is an immunogenic molecule, such as a protein, that is, generally, expressed at a higher level in tumor cells than in non-tumor cells, in which, preferably, it may not be expressed at all, or only at low levels. A tumor associated antigen, or TAA, is said to be "universal" if it is expressed in tumors of different origins.

A "cytochrome P450 1B1 polypeptide," or a "CYP1B1 polypeptide" is a full length, non-fragmented polypeptide of CYP1B1, while a "cytochrome P450 1B1 peptide," or a "CYP1B1 peptide," is (or includes) a fragment of such a CYP1B1 polypeptide. CYP1B1 peptides can be of any length, up to just under the full length of a CYP1B1 polypeptide. However, preferably, for use in the invention, CYP1B1 peptides are of a relatively short length, such as, for example, eight, nine, ten, eleven, or twelve amino acids. Also, a CYP1B1 peptide may include sequences that are not present in a corresponding CYP1B1 polypeptide, provided that the CYP1B1 peptide also includes a stretch of at least, for example, eight, nine, ten, eleven, or twelve consecutive amino acids that have a sequence that is identical to a sequence of eight, nine, ten, eleven, or twelve consecutive amino acids in a CYP1B1 polypeptide.

Peptides including amino acid substitutions can also be considered as CYP1B1 peptides. For example, a CYP1B1 peptide can include a region of at least nine amino acids, of which any six or more are identical to the amino acids within a nine amino acid stretch in CYP1B1. Preferably, at least seven, more preferably, at least eight, and, most preferably, all nine of the amino acids in a CYP1B1 peptide nine amino acid region are identical to a nine amino acid region in the CYP1B1.

A CYP1B1 polypeptide corresponding to CYP1B1 includes 533 amino acids that are substantially identical (see below) to the amino acid sequence of CYP1B1 (Sutter et al., J. Biol. Chem. 269:13092-13099, 1994; Tang et al., J. Biol. Chem. 271:28324-28330, 1996; Genbank Accession No. U56438), or such a polypeptide can include the amino acid sequence of CYP1B1, as well as additional sequences.

As is discussed further below, it is preferable that CYP1B1 polypeptides of the invention include regions that bind to major histocompatibility complex (MHC) antigens. Preferred examples of CYP1B1 peptides that are included in the invention are CYP239 (SEQ ID NO: 1), CYP246 (SEQ ID NO:2), CYP190 (SEQ ID NO:3), and CYP528 (SEQ ID NO:4). Additional CYP1B1 peptides are listed in the Sequence Appendix, as well in Tables 3-10, and still more CYP1B1 peptides can be identified using methods described below (also see PCT/US99/25438).

A CYP1B1 peptide or polypeptide can be fused to amino acid sequences that do not naturally occur in CYP1B1. Moreover, a CYP1B1 peptide or polypeptide can be attached to the surface of a cell or to a molecule or a macromolecule (e.g., a histocompatibility antigen), or a CYP1B1 peptide or polypeptide can be conjugated to immunogens or adjuvants that are known to those of skill in this art, for example, keyhole limpet hemocyanin (KLH), for the purpose of eliciting a CYP1B1-specific immune response. As is noted above, preferred examples of CYP1B1 peptides are CYP239 (SEQ ID NO:1), CYP246 (SEQ ID NO:2), CYP190 (SEQ ID NO:3), and CYP528 (SEQ ID NO:4).

By "CYP1B1 nucleic acid molecule" is meant a DNA or RNA (e.g., mRNA) molecule that encodes a CYP1B1 polypeptide or CYP1B1 peptide, as are defined above.

By "CYP1B1-expressing tumor cell" is meant a tumor cell that expresses CYP1B1. A CYP1B1-expressing tumor cell can express a level of CYP1B1 that is equal to, or, preferably, greater than the level of CYP1B1 expressed by the normal cell type from which the CYP1B1-expressing tumor cell has originated, or other non-tumor cells. Preferably, the tumor cell expresses at least 10% more CYP1B1, more preferably, at least 25% more, still more preferably at least 50% more, and most preferably at least 150% more CYP1B1 than the normal cell type from which the CYP1B1-expressing tumor cell has originated, or another non-tumor cell. CYP1B1 expression levels in a CYP1B1-expressing tumor cell can be increased by, for example, increased transcription of the CYP1B1 gene, increased CYP1B1 mRNA stability or translation, increased CYP1B1 polypeptide stability, or increased CYP1B1 enzymatic activity. Increasing such CYP1B1 expression levels may be useful in the invention to increase the likelihood that a tumor cell will be recognized as a target of the immunotherapeutic methods described herein (see below).

By "histocompatibility antigen" is meant a molecule, such as a major histocompatibility complex (MHC) class I, MHC class II, or minor histocompatibility antigen, that mediates interactions of cells of the immune system with each other and with other cell types. Examples of histocompatibility antigens include MHC class I antigens, such as HLA-A (e.g., A1, A2, A3, A11, A24, A31, A33, and A38), HLA-B, and HLA-C, MHC class II antigens, such as HLA-DR, HLA-DQ, HLA-DX, HLA-DO, HLA-DZ, and HLA-DP, and minor histocompatibility antigens, such as HA-1.

By "generating CTLs" is meant an in vivo, in vitro, or ex vivo process by which CTLs (e.g., CYP1B1-specific CTLs) are activated (e.g., stimulated to grow and divide) and/or selected.

A peptide of CYP1B1 is said to "specifically bind" to an MHC antigen if the peptide adheres to a histocompatibility antigen under physiological conditions. For example, such binding can be similar to that of a peptide antigen that is naturally processed and presented in the context of MHC in an antigen presenting cell.

A cytotoxic T lymphocyte (CTL) or antibody is said to "specifically recognize" a CYP1B1 polypeptide or a CYP1B1 peptide if it binds to the polypeptide or peptide, but does not substantially bind to other, unrelated polypeptides or peptides.

A CTL is said to "specifically kill" a cell if it specifically recognizes and lyses a cell that expresses an antigen (e.g., CYP1B1) to which it has been activated, but does not substantially recognize or lyse cells not expressing the antigen. In the case of CYP1B1, such a CTL is designated as a "CYP1B1-specific CTL" herein.

By "CYP1B1-specific antibody" is meant an antibody that can specifically recognize and bind to a CYP1B1 peptide or polypeptide, and that does not substantially recognize and bind to other, unrelated molecules.

A CYP1B1 polypeptide is "presented" if a peptide of CYP1B1 is displayed on the extracellular surface of a cell (e.g., an antigen presenting cell), such that it can result in the in vivo, ex vivo, or in vitro generation of CYP1B1-specific CTLs or the lysis of a tumor cell by a CYP1B1-specific CTL. Preferably, the displayed CYP1B1 peptide is bound to a histocompatibility antigen.

By "physiological conditions" is meant the in vivo environment in which CYP1B1-specific CTLs are generated (activated and/or selected) and perform their biological functions (e.g., recognition of a CYP1B1 peptide and MHC-restricted lysis of CYP1B1-expressing tumor cells), or an in vitro or ex vivo environment that allows CYP1B1-specific CTLs to be generated and to perform their biological functions.

By "CYP1B1 vaccination" is meant administration of an immunogenic preparation including one or more CYP1B1 peptides, CYP1B1 polypeptides, CYP1B1 nucleic acid molecules, fragments of any of these molecules, CYP1B1-presenting cells (e.g., dendritic cells or CD40-activated B cells), or mixtures thereof. Vaccination is performed on a subject who has a tumor, has a history of having a tumor or tumors, is likely to develop a tumor, or any healthy individual to prevent tumors, or on a subject in which CYP1B1-specific immune cells (such as CTLs) are to be generated for transfer into a patient. Such vaccination stimulates a CYP1B1-specific immune response within the subject. In subjects having tumors, the vaccination can result in partial or complete inhibition of tumor growth, or partial or complete tumor regression, provided that the patient's tumor expresses CYP1B1. In addition, vaccination can provide prophylaxis against the development of new CYP1B1-expressing tumors.

A "vaccine," as used herein, is an immunogenic composition that can be administered in the vaccination method described above. Thus, a vaccine includes, for example, one or more CYP1B1 peptides, CYP1B1 polypeptides, CYP1B1 nucleic acid molecules, fragments of any of these molecules, CYP1B1-presenting cells (e.g., dendritic cells or CD40-activated B cells), or mixtures thereof. Optionally, a vaccine composition can also include an adjuvant, which is a molecule that stimulates an immune response to a co-administered vaccine antigen. Examples of adjuvants that can be used in the invention are provided below. A vaccine composition can also include other tumor associated antigens (e.g., hTERT) or peptides thereof (PCT/US99/25438).

By "immune cell" is meant any cell that plays a role in cell-mediated or humoral immunity, including CTLs and antigen-presenting cells, e.g., B cells, T helper cells, and dendritic cells.

By "sample" is meant a tumor or tissue biopsy, a lymph node biopsy, bone marrow, cells, blood, serum, urine, stool, sputum, saliva, or other specimen obtained from a patient. A sample can be analyzed to determine the level of CYP1B1-specific CTLs, the level of CYP1B1-specific antibodies, or the level of any other immune response indicator (e.g., a cytokine) in the patient from whom it was taken by methods that are known in the art. For example, ELISA can be used to measure levels of CYP1B1-specific antibodies, and ELISPOT can be used to measure cytokine levels. Also, $Cr^{51}$ release (T cell cytotoxicity) assays and assays that test the binding of CTLs to tetrameric CYP1B1 peptide/MHC complexes, as described herein, can be used to measure levels of CYP1B1-specific CTLs.

By "reference sample" is meant a sample in which the level of CYP1B1-specific CTLs or the level of CYP1B1-specific antibodies have been measured, and to which the level of CYP1B1-specific CTLs or the level of CYP1B1-specific antibodies in a test subject's sample are compared. Reference levels can be higher, lower, or the same as patient sample levels. Comparison of a test sample to a reference sample provides an assessment of the CYP1B1-specific immune response in the test subject. In addition, comparison of a patient's sample levels to reference sample levels can allow a diagnosis of cancer and/or a prognosis of a cancer in a patient having a tumor that includes CYP1B1-expressing cells.

By "cancer treatment" is meant any therapy (e.g., chemotherapy, radiation therapy, administration of a tumor associated antigen (e.g., CYP1B1)-specific CTLs, administration of an APC presenting a peptide of a TAA (e.g., CYP1B1), or vaccination with a TAA (e.g., CYP1B1), a nucleic acid molecule encoding a TAA (e.g., CYP1B1), or a fragment thereof, to enhance an anti-tumor immune response) administered either alone or in combination with other therapies, that alleviates disease in at least some patients to which the treatment is administered. For example, a cancer treatment can reduce or inhibit tumor growth, or can induce partial or complete tumor regression. Furthermore, a cancer treatment can be prophylactic, in that it inhibits or prevents the development of new tumors in healthy individuals, in patients that are in remission from cancer, have metastatic cancer, or have a high risk of developing cancer.

By "inhibiting the development of a tumor" is meant administering a protective therapy (such as CYP1B1-specific CTLs, CYP1B1 peptide presenting APCs, or a vaccine including, for example, one or more CYP1B1 peptides, CYP1B1 polypeptides, or CYP1B1 nucleic acid molecules, or a combination thereof) to a subject adjudged to have a higher than average risk of developing a tumor. Subjects with a relatively high risk of developing a tumor include those having a family history of cancer, those having one or more genetic mutations that are associated with a high risk for cancer (e.g., a mutation that inactivates a tumor suppressor gene), those having relatively high levels of CYP1B1-specific CTLs or CYP1B1-specific antibodies, those who have cancer or are in remission from cancer, and those who have been exposed to agents known or suspected to cause cancer.

By "pharmaceutically acceptable carrier" is meant a carrier that is physiologically acceptable to a treated patient, while retaining the therapeutic properties of the compound with which it is administered. One exemplary pharmaceutically acceptable carrier is physiological saline. Other physiologically acceptable carriers and their formulations are known to those skilled in the art, and are described, for example, in Remington's Pharmaceutical Sciences (18th edition), ed. A. Gennaro, 1990, Mack Publishing Company, Easton, Pa.

The term "substantially identical" is used herein to describe a polypeptide or nucleic acid molecule exhibiting at least 50%, preferably at least 85%, more preferably at least 90%, and most preferably at least 95% identity to a reference amino acid or nucleic acid sequence. For polypeptides, the length of comparison sequences is at least 8 amino acids, preferably at least 16 amino acids, more preferably at least 25 amino acids, and most preferably 35 amino acids. For nucleic acid molecules, the length of comparison sequences is at least 24 nucleotides, preferably at least 50 nucleotides, more preferably at least 75 nucleotides, and most preferably at least 110 nucleotides. Sequence identity is typically measured using sequence analysis software with the default parameters specified therein (e.g., Sequence Analysis Software Package of the Genetics Computer Group, University of Wisconsin Biotechnology Center, 1710 University Avenue, Madison, Wis. 53705). The CYP1B1 polypeptides, peptides, and nucleic acid molecules of the invention can be identical or substantially identical to naturally occurring molecules, and thus may or may not include non-wild type sequences.

By "substantially pure peptide" or "substantially pure polypeptide" is meant a peptide, polypeptide, or a fragment thereof, which has been separated from the components that naturally accompany it. Typically, the peptide or polypeptide is substantially pure when it is at least 60%, by weight, free from the proteins and naturally-occurring organic molecules with which it is naturally associated. Preferably, the peptide or polypeptide is a CYP1B1 peptide or polypeptide that is at least 75%, more preferably at least 90%, and most preferably at least 99%, by weight, pure. A substantially pure CYP1B1 peptide or polypeptide can be obtained, for example, by extraction from a natural source (e.g., a tumor cell), by expression of a recombinant nucleic acid molecule encoding a CYP1B1 peptide or polypeptide, or by chemically synthesizing the peptide or polypeptide. Purity can be measured by any appropriate method, e.g., by column chromatography, polyacrylamide gel electrophoresis, or HPLC analysis.

A protein is substantially free of naturally associated components when it is separated from those contaminants that accompany it in its natural state. Thus, a protein that is chemically synthesized or produced in a cellular system different from the cell from which it naturally originates is substantially free from its naturally associated components. Accordingly, substantially pure peptides and polypeptides not only include those derived from eukaryotic organisms, but also those synthesized in E. coli or other prokaryotes.

By "substantially pure DNA" or "isolated DNA" is meant DNA that is free of the genes that, in the naturally-occurring genome of the organism from which the DNA is derived, flank the gene. The term thus includes, for example, a recombinant DNA that is incorporated into a vector; an autonomously replicating plasmid or virus; or the genomic DNA of a prokaryote or eukaryote; or DNA that exists as a separate molecule (e.g., a cDNA, or a genomic or cDNA fragment produced by PCR or restriction endonuclease digestion) independent of other sequences. It also includes a recombinant DNA that is part of a hybrid gene encoding additional polypeptide sequence.

By "transformation," "transfection," or "transduction" is meant any method for introducing foreign molecules into a cell. Lipofection, DEAE-dextran-mediated transfection, microinjection, protoplast fusion, calcium phosphate precipitation, transduction (e.g., bacteriophage, adenoviral retroviral, or other viral delivery), electroporation, and biolistic transformation are just a few of the methods known to those skilled in the art that can be used in the invention.

By "transformed cell," "transfected cell," or "transduced cell," is meant a cell (or a descendent of a cell) into which a nucleic acid molecule (e.g., a DNA or RNA molecule) encoding a polypeptide of the invention has been introduced by means of recombinant DNA techniques.

By "promoter" is meant a minimal sequence sufficient to direct transcription. Promoter elements that are sufficient to render promoter-dependent gene expression controllable for cell type-specific, tissue-specific, temporal-specific, or inducible by external signals or agents can also be used in the invention; such elements can be located in the 5' or 3' or intron sequence regions of the native gene.

By "operably linked" is meant that a gene and one or more regulatory sequences are connected in such a way as to permit gene expression when the appropriate molecules (e.g., transcriptional activator proteins) are bound to the regulatory sequences.

By "expression vector" is meant a genetically engineered plasmid or virus, derived from, for example, a bacteriophage, adenovirus, retrovirus, poxvirus, herpesvirus, or artificial chromosome, that is used to transfer a peptide or polypeptide coding sequence (e.g., a CYP1B1 peptide coding sequence), operably linked to a promoter, into a host cell, such that the encoded peptide or polypeptide is expressed within the host cell.

Other features and advantages of the invention will be apparent from the drawings, following detailed description, and the claims.

BRIEF DESCRIPTION OF THE DRAWINGS

FIGS. 4A-4H are graphs showing that CYP239 and CYP246-specific CTL are cytotoxic for HLA-A2+ melanoma, multiple myeloma and ovarian carcinoma cell lines. Expression of CYP1B1 in all tumor cell lines was confirmed by Western blot analysis. HLA-A2+ cell lines are shown by solid symbols; HLA-A2− cell lines by open symbols. Targets for CYP239-specific CTL (upper panel) and CYP246-specific CTL (lower panel) were (A, B) melanoma cell lines K029 (●) and SK-MEL-2 (○), (C, D) multiple myeloma cell lines U266 (●), IM-9 (♦) and HS-Sultan (◇), and (E, F) ovarian carcinoma cell lines 36M (■) and SK-OV-3 (□). Normal cells including the HLA-A2+ fibroblast cell line GM847 (Δ) and primary monocytes from 3 HLA-A2+ (○, ◇, ∇) and one HLA-A2− healthy donors (□) were not lysed by either (G) CYP239-specific or (H) CYP246-specific CTL. Results of one representative experiment are shown. Similar results were obtained for each of 2 to 6 CTL tested per target.

FIGS. 6A-6C are graphs showing lysis of CYP1B1+ HLA-A2+ primary lymphoma and acute myeloid leukemia (AML). Two HLA-A2+CYP1B1+ follicular lymphoma samples (■ and ●) from lymph node biopsies were lysed by (A) CYP239-specific and (B) CYP246-specific CTL, while no cytotoxicity occurred against an HLA-A2− CYP1B1+ FL (□). Experiments were performed from two different normal donors with similar results. (C) CYP239-specific CTL lysed primary HLA-A2+ (♦), but not HLA-A2− (◇) AML cells.

DETAILED DESCRIPTION

Figure 1:
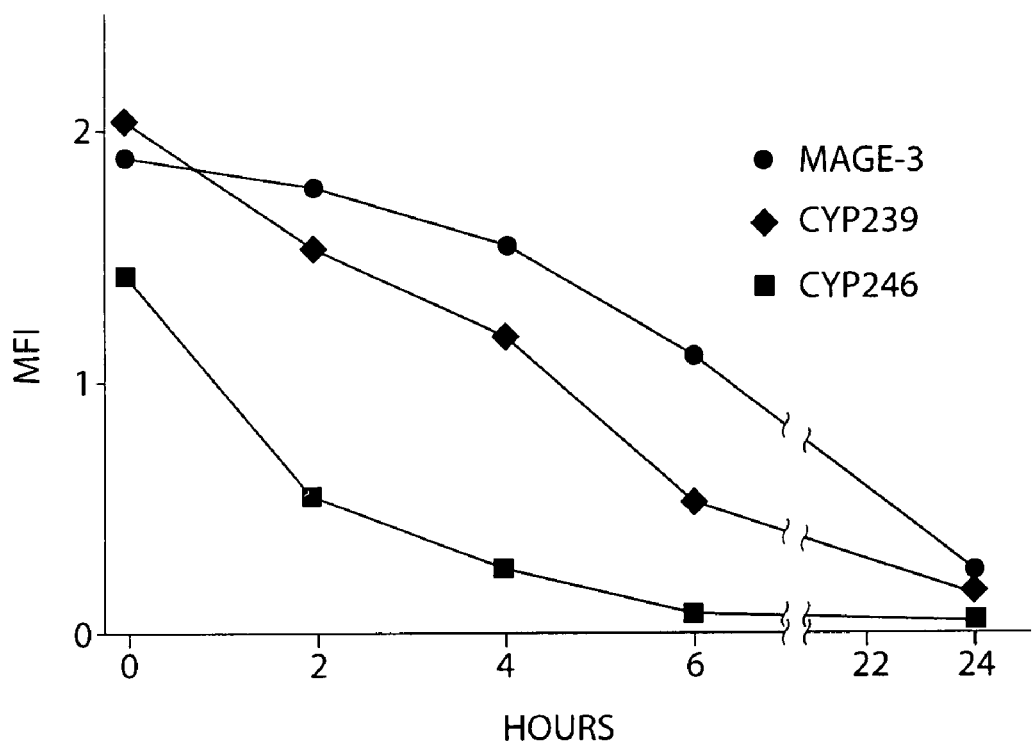
FIG. 1 is a graph showing the level of peptide binding of MAGE-3, CYP239, and CYP246 to TAP-deficient T2 cells.

We have discovered that cytochrome P450 1B1 (CYP1B1) includes peptides that bind to HLA molecules. Antigen presenting cells (APCs) that present such peptides on their surfaces, in complexes with HLA, can activate cytotoxic T lymphocytes (CTLs) to specifically lyse cells expressing CYP1B1, in an MHC-restricted fashion. The invention thus provides methods for immunotherapeutic targeting of CYP1B1-expressing cells, such as cancer cells, and methods of monitoring the efficacy of such therapeutic methods.

Based on our observations that CYP1B1 is a mediator of dioxin-related effects on tumorigenesis, in combination with searches of public literature databases, such as PubMed, we identified CYP1B1 as a potential universal tumor antigen. It is overexpressed in nearly 100% of human tumors (Murray et al., Cancer Res. 57:3026-3031, 1997), whereas the expression in normal tissue is low and limited to steroidogenic and steroid-responsive tissue (Buters et al., Proc. Natl. Acad. Sci. USA 96:1977-1982, 1999). CYP1B1 is a member of the superfamily of monooxygenases responsible for the metabolic activation of environmental carcinogens. Mice lacking CYP1B1 have a much lower incidence of lymphoma than wild type mice after challenge with polycyclic aromatic hydrocarbons, further implicating that CYP1B1 plays a role in oncogenesis.

T cell Mediated Anti-Tumor Immunity

As is noted above, there is considerable evidence that human T cells can specifically lyse tumor cells (Rosenberg, Immunity 10:281-287, 1999). Most attention has been focused on CD8+ CTLs as the principle effector cells of antigen-specific anti-tumor immunity. Chief among the recent discoveries that have helped propel clinical efforts has been the characterization of tumor associated antigens (TAAs) (Boon et al., Annual Review of Immunology 12:337-365, 1994). Pioneering studies in the early 1990s demonstrated the existence of human TAAs using patients' CTLs that recognized peptides derived from these antigens (Van Pet et al., Immunological Reviews 145:229-250, 1995; Rosenberg, Immunol. Today 18:175-182, 1997). Although these studies primarily focused on melanoma, TAAs have been subsequently characterized in several other malignancies (Van Pel et al., Immunological Reviews 145:229-250, 1995; Rosenberg, Immunol. Today 18:175-182, 1997; Van den Eynde et al., Curr. Opin. Immunol. 9:684-693, 1997), raising the hypothesis that most, if not all, tumors express antigens that CTL can potentially attack. The demonstration that TAA-specific immune responses can lead to tumor regression has been borne out extensively in animal models (Rosenberg, Immunity 10:281-287, 1999). Although the identification of TAAs using patients' CTLs has revitalized the field of T cell immunotherapy, these methods are slow, very expensive, and labor-intensive. Moreover, the strategy relies on the generation of tumor-specific T cell clones in vitro, suggesting that only a restricted set of TAAs will be identified by this method. With these limitations in mind, Pfreundschuh and colleagues developed an alternative approach, SEREX (serological identification of antigens by recombinant expression cloning), to identify TAAs (Sahin et al., Curr. Opin. Immunol. 9:709-716, 1997). SEREX makes use of patients' antibody responses to tumor-derived genes and this strategy has accelerated the identification of TAAs significantly. Although several T cell-defined TAAs, such as the MAGE genes, have also been identified by SEREX, there is no information available about CTL epitopes for the vast majority of genes in the SEREX database, and, of course, such epitopes are required to activate a CTL response.

Although there is no doubt that the identification of numerous TAAs by CTL-based approaches or SEREX reflects the existence of an anti-tumor immune response, it remains to be determined if these antigens play a role as tumor regression antigens (Sarma et al., J. Exp. Med. 189:811-820, 1999). As is mentioned above, most T cell epitopes in TAAs identified by patient CTLs have been demonstrated to be of low MHC binding affinity and/or low MHC/peptide complex stability. Clinical vaccination trials have circumvented this obstacle by utilizing altered peptides with higher MHC binding affinity and higher MHC/peptide complex stability (Rosenberg et al., Nat. Med. 4:321-327, 1998). This quality distinguishes TAA-derived peptides from viral peptides that are almost exclusively of high binding affinity and high MHC/peptide complex stability (Feltkamp et al., Mol. Immunol. 31:1391-1401, 1994; Sette et al., J. Immunol. 153:5586-5592, 1994). The low binding affinity of TAA-derived peptides is likely to be one of the reasons why natural CTL responses against such peptides are not successful for tumor eradication. This is in agreement with the finding that large numbers of TAA-specific CTLs co-exist with metastatic tumors in melanoma patients (Romero et al., J. Exp. Med. 188:1641-1650, 1998). A recent study has even demonstrated that despite expansion, such CTLs were hyporesponsive, showing reduced cytotoxic and cytokine responses (Lee et al., Nat. Med. 5:677-685, 1999).

To overcome these limitations of currently known TAAs, we have developed methods to identify more universal TAAs, and, in particular, those containing T cell epitopes with high MHC binding affinity and high MHC/peptide complex stability. Such TAAs and MHC-binding peptides thereof can trigger sufficient CTL responses against a broad range of tumor types. Rather than analyzing tumor-derived T cell clones or tumor-specific antibodies derived from patients, an alternative strategy was used, in which TAA and their CTL epitopes are deduced from genes known to be selectively expressed in tumors. By combining bioinformatics to predict peptides that bind to HLA with high affinity, peptide binding analysis, and a powerful in vitro T cell expansion system, the cytochrome P450 1B1 (CYP1B1) was identified (see below). This TAA contains at least two peptide epitopes that (1) bind to HLA-A*0201 with high affinity and high MHC/peptide complex stability, (2) are naturally processed and presented by HLA-A*0201 molecules on the cell surface of a panel of tumor cell lines, (3) elicit peptide-specific HLA-restricted CTL responses, and (4) are recognized by such CTL on a wide variety of different tumor histologies.

Deducing CTL Epitopes in Tumor Associated Antigens (TAAs): Making use of Genomics and Proteomics for Tumor Immunology Current developments in genomics and proteomics suggest that numerous TAA candidate genes can be identified. The Human Genome Project (HGP), the Human Cancer Gene Anatomy Project (CGAP), the SEREX database, and other databases, including literature databases such as PubMed, provide an enormous set of data that can be analyzed to identify genes that fulfill the criteria of universal tumor antigens, as are described above. It is clear that entering the post-genomic era, none of the classical approaches to characterize TAA, including T cell cloning and testing of T cell clones against expression libraries (Boon et al., Annual Review of Immunology 12:337-365, 1994), is suitable for the analysis of the ever-growing databases to identify a set of universal tumor antigens.

To overcome the limitations of prior methods in determining CTL epitopes, advances in bioinformatics can be applied. First, database mining and integration can be used to identify of universal tumor antigen candidates, which are genes that are expressed at a much higher level in tumor cells than in normal cells. Then, computational methods are used to predict peptides derived from these proteins for high-affinity binding to MHC molecules. The requirements for peptides to bind to class I HLA molecules and to elicit CTL responses have been studied extensively (Rammensee et al., Annual Review of Immunology 11:213-244, 1993; Sidney et al., Immunology Today 17:261-266, 1996). The strength of CD8+ CTL responses depends upon the binding affinity of the target peptide to MHC, the peptide-MHC complex stability, and the avidity of T cell receptor (TCR) binding for the peptide complex (Sette et al., J. Immunol. 153:5586-5592, 1994; van der Burg et al., J. Immunol. 156:3308-3314, 1996; Savage et al., Immunity 10:485-492, 1999; Gallimore et al., Eur. J. Immunol. 28:3301-3311, 1998). These factors directly influence the efficiency of peptide loading and the number of peptides expressed on the cell surface (Gallimore et al., Eur. J. Immunol. 28:3301-3311, 1998). The vast majority of viral-derived immunodominant peptides are of high binding affinity and/or peptide-HLA complex stability (Feltkarnp et al., Mol. Immunol. 31:1391-1401, 1994; Sette et al., J. Immunol. 153:5586-5592, 1994). Since only a very small portion of peptides can bind to MHC molecules, rapid and accurate methods to identify them, such as those used in the present invention, can expedite the search for CTL epitopes by orders of magnitude.

A great deal of effort has been expended on the development of computational methods to identify peptides that bind strongly to various MHC alleles. It began with the work of Rammensee and colleagues, who identified motifs in peptide sequences that serve as signatures of the MHC molecules to which they bind (Rammensee et al., Immunogenetics 41:178-228, 1995). Motif-based methods have recently been applied to the identification of CTL epitopes deduced from proteinase 3 (Molldrem et al., Blood 88:2450-2457, 1996), MAGE-3 (Nijman et al., Eur. J. Immunol. 23:1215-1219, 1993), MUC-1 (Brossart et al., Blood 93:4309-4317, 1999), and telomerase (PCT/US99/25438).

Typically, only 20% of peptides that carry the motif bind to the respective MHC molecule. The inclusion of "secondary anchor" positions (Ruppert et al., Cell 74:929-937, 1993), the so-called extended motif, significantly improves the specificity of motif-based methods, but they are available only for HLA-A*0201 (Ruppert et al., Cell 74:929-937, 1993) and HLA-B*3501 (Schbnbach et al., J. 10 Immunol. 154:5951-5958, 1995). Many other statistically-based computational methods have been developed (for reviews, see, e.g., Hammer, Curr. Opin. Immunol. 7:263-269, 1995; Parker et al., Immunol. Res. 14:34-57, 1995), including the polynomial method (Gulukota et al., J. Mol. Biol. 267:1258-1267, 1997), methods based on neural nets (Gulukota et al., J. Mol. Biol. 267:1258-1267, 1997; Brusic et al., Bioinformatics 14:121-130, 1998; Brusic et al., Nucleic Acids Res. 26:368-371, 1998), a method that assigns a score for each amino acid at each position as determined experimentally via single residue substitutions (Hammer et al., J. Exp. Med. 180:2353-2358, 1994), and a method developed by Parker et al. based on a database of the half-lives of bound β2-microglobulin (β2m) in MHC-peptide complexes (Parker et al., J. Immunol. 152: 163-175, 1994). The method developed by Parker et al. assumes that the dissociation of β2m is rate-limited by the dissociation of peptide, so that variation in the microglobulin half-life reflects variation in the peptide half-life. The variation is, in turn, assumed to reflect the variation in the binding affinity of the peptide. A weight matrix is then determined to best reflect the half-lives, assuming that the contribution of one peptide position does not depend on its neighboring positions.

Weng and colleagues have recently developed a new statistical method (implemented as a computer program named LPpep; Weng et al.) to predict strong HLA-A*0201-binding peptides. It determines the contributions for each of the 20 amino acids at each of the positions of a peptide using a linear programming algorithm. When tested on a data set of over 1000 peptides having known binding affinities, LPpep has a higher sensitivity (>0.75) and specificity (>0.9) than four other available methods.

High Volume Analysis of Peptide MHC Affinity and MHC/Peptide Complex Stability

The basic principles of peptide binding to MHC molecules have been well established in the field (Rammensee et al., Annual Review of Immunology 11:213-244, 1993; Rothbard et al., Annual Review of Immunology 9:527-565, 1991; Engelhard, Annual Review of Immunology 12:181-207, 1994; Madden, Annual Review of Immunology 13:587-622, 1995; Parner et al., Annual Review of Immunology 16:323-358, 1998; Rock et al., Annual Review of Immunology 17:739-779, 1999), and numerous assay systems have been developed to analyze the binding of any given peptide to MHC molecules. Binding has been analyzed using intact TAP-deficient cells (Salter et al., EMBO J. 5:943-949, 1986; Schumacher et al., Cell 62:563-567, 1990) and by in vitro assays utilizing purified HLA molecules (Ruppert et al., Cell 74:929-937, 1993; Schumacher et al., Cell 62:563-567, 1990; Townsend et al., Cell 62:285-295, 1990). While most assay systems have focused on the maximal binding affinity, it has recently been suggested that the dissociation rate of MHC and peptide (also measured as MHC/peptide complex stability) may be a more important determinant for characterizing a peptide as a dominant T cell epitope (van der Burg et al., J. Immunol. 156:3308-3314, 1996; Busch et al., J. Immunol. 160:4441-4448, 1998; Kammer et al., J. Exp. Med. 190:169-176, 1999).

In Vitro Analysis of CTL Responses

The generation of antigen-specific T cells in vitro is a classical immunological technique. Antigen-specific T cells can be generated relatively easily if the peptides used to make such cells are: (1) immunodominant, (2) of viral or other non-self origin, (3) expressed at a reasonably high copy number on the cell surface (Porgador et al., Immunity 6:715-726, 1997), and (4) of high affinity for, and of low dissociation rate (high MHC/peptide complex stability) from, MHC, and if the T cell pool under study has been exposed to the antigen in vivo prior to ex vivo analysis (recall response). The frequency analysis of peptide-specific T cells by tetramer technology (see below) revealed a significantly higher frequency than earlier assays based on in vitro expansion had suggested.

It is therefore apparent that only a fraction of specific CTLs are expanded in classical in vitro systems utilizing unstimulated peripheral blood mononuclear cells (PBMC) as antigen presenting cells (McMichael et al., J. Exp. Med. 187:1367-1371, 1998). To circumvent these pitfalls, in vivo systems utilizing transgenic mice carrying human HLA genes have been introduced (Man et al., International Immunology 7:597-605, 1995; Wentworth et al., International Immunology 8:651-659, 1996; Alexander et al., J. Immunol. 159: 4753-4761, 1997). However, these systems are expensive and are not suitable for screening multiple peptide epitopes simultaneously. Making use of new findings in basic immunology, it is possible to optimize further currently available in vitro culture technology. The use of an APC instead of PBMC as stimulators is only one example.

We have developed a system that utilizes dendritic cells (DC) for primary activation and CD40-activated B cells (CD40-B) for re-stimulation, thereby mimicking the physiological sequence of events between T cells and APCs during an ongoing immune response (Schultze et al., J. Exp. Med. 89:1-12, 1999; Schultze et al., J. Clin. Invest. 100:2757-2765, 1997). This system has been successfully used for the identification of T cell epitopes derived from hTERT and the clonal immunoglobulin in B cell malignancies (PCT/US99/25438). From a single blood draw, professional APCs, including DCs and CD40-activated B cells, are generated, and the remaining PBMCs are enriched for CD8+ T cells. T cells are primarily stimulated with peptide-pulsed DC, and repeatedly stimulated with peptide-pulsed CD40-B cells. Peptide-specificity and HLA-restriction is analyzed after a total of 2-5 stimulations, depending on the antigen under study. This system is not only very powerful in amplifying rare T cells against TAA-derived peptides, but has several other advantages: (1) it is relatively cheap compared to transgenic mice, (2) a single blood draw is sufficient to generate all cellular components necessary, and (3) the use of professional APCs for restimulation is superior to PBMC.

Classically, the function of CTLs in vitro has been defined by cytotoxicity assays using radioactive chromium. Clearly, cytotoxicity analysis is an important component of the characterization of a novel TAA, since tumor cell lysis is the ultimate goal of any TAA-directed immunotherapeutic intervention. However, such assays are not suitable to determine the frequency of peptide-specific CTLs. In addition, the sensitivity of cytotoxicity assays to identify very small numbers of specific CTLs is insufficient. To detect very low numbers of specific CTLs and to determine their frequency, two new technologies, namely the tetramer technology (Altman et al., Science 274:94-96, 1996) and cytokine ELISPOT analysis (Herr et al., J. Immunol. Methods 203:141-152, 1997), have been developed and applied to tumor immunology. In particular, tetramers have been suggested as a tool to enrich CTL lines for peptide-specific CTL (Dunbar et al., Curr. Biol. 8:413-416, 1998; Yee et al., J. Immunol. 162:2227-2234, 1999; Valmori et al., Cancer Res. 59:2167-2173, 1999). Currently, the tetramer technology is still technically demanding and it is not possible to generate numerous tetramers in small quantities to screen peptide-specific CTL responses against a larger set of unknown peptides. For this purpose, cytokine ELISPOT is more suitable (Herr et al., J. Immunol. Methods 203:141-152, 1997).

Experimental Results

The Dioxin-Inducible Cytochrome P450 1B1 (CYP1B1)

Using the methods described above (also see PCT/US99/25438), we identified the dioxin-inducible cytochrome P450 1B1 (CYP1B1) as a potential TAA. A list of peptides predicted to bind to all HLA alleles available are listed in the Sequence Appendix. The prediction was carried out using three different algorithms that are freely available on the Internet.

Analysis of the CYP1 sequence by two independent prediction algorithms (BIMAS and LPpep, see Experimental Methods, below) revealed two peptides (CYP239 and CYP246) predicted to bind to HLA-A*0201, the most common HLA allele (Table 1). These peptide sequences are unique in the public gene databases and in particular are not found within any other member of the cytochrome P450 family. (Also see below for additional CYP1B1 peptides (e.g., CYP190 and CYP528) identified according to the invention.)

Peptide Binding of CYP1B1 Derived Peptides

Binding of both peptides to HLA-A2, as well as their complex stability, was determined using a cellular assay employing TAP-deficient T2 cells (Table 1; PCT/US99/25438). Both peptides stabilized HLA-A2 molecules on the surface of T2 cells to a similar extent as a positive control peptide (F271) derived from the tumor antigen MAGE-3 (Nijman et al., Eur. J. Immunol. 23:1215-1219, 1993), which is known to bind HLA-A2 with high affinity. In particular, T2 cells were incubated with peptide in serum-free medium for up to 18 hours, harvested, washed, and subsequently stained with FITC-labeled anti-HLA-A2 mAb BB7.2 (maximum peptide binding). Increase in fluorescence intensity was determined as a function of peptide binding. For analysis of complex stability, T2 cells were cultured in serum-free media for an additional 2, 4, 6, or 24 hours, and subsequently analyzed for HLA-A2 expression by flow cytometry. As is shown in FIG. 1, the MAGE-3-derived peptide, which induces CTL responses in the majority of all normal donors, demonstrated high binding affinity and complex stability. Although both CYP1B1-derived peptides bound to HLA-A2, CYP246 showed a significantly lower complex stability than CYP239 and MAGE-3. Moreover, attempts to induce CTL responses were successful in 13/15 donors against CYP239, but only 4/9 donors for CYP246. Our data further show that complex stability might be a more important factor than binding affinity for the likelihood to generate peptide-specific CTL responses.

TABLE 1

Binding of CYP1B1 and control peptides to human HLA-A*201

| Sequence | BIMAS | LPpep | Binding affinity [F1] |
|---|---|---|---|
| SLVDVMPWL (SEQ ID NO: 5) | 1108 | 2.88 | 3.8 |
| WLQYFPNPV (SEQ ID NO: 6) | 1216 | 6.23 | 3.4 |
| FLWGPRALV (SEQ ID NO: 7) | 2655 | 7.63 | 3.2 |

Peptide-Specific Killing

Figure 2A:
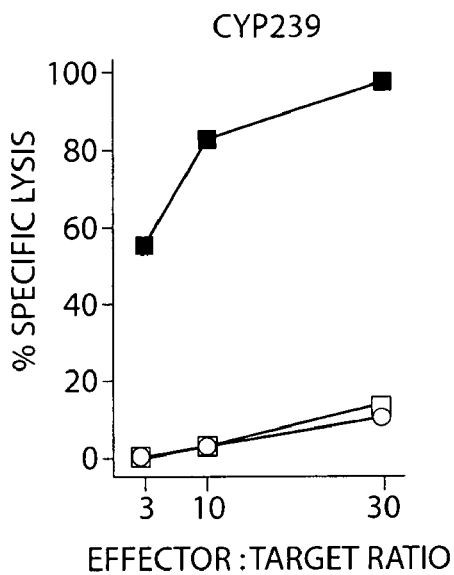
FIGS. 2A-2D are graphs showing that CTL derived from healthy donors recognize CYP239 and CYP246 peptides. (A) CTL raised against the CYP239 peptide specifically lyse CYP239 pulsed (■), but not unpulsed T2 cells (□), or T2 cells pulsed with an irrelevant peptide (○; F271 from MAGE-3). (B) Similarly, CTL generated against the CYP246 peptide recognize only T2 cells pulsed with CYP246 (■), but not control T2 cells (□, unpulsed; ○, pulsed with F271). The diagrams display representative experiments for 11/13 healthy donors positive for CYP239-specific CTL induction and 4/10 healthy donors positive for CYP246-specific CTL induction. (C) CYP239-specific CTL recognize autologous CD40-B cells pulsed with CYP239 peptide (♦), but not unpulsed autologous CD40-B (◇) or allogeneic HLA-A2 mismatched CD40-B unpulsed (○) or pulsed with CYP239 peptide (●). (D) Analogous results were obtained for CYP246-specific CTL using the same target cells unpulsed or pulsed with the CYP246 peptide.
Figure 2B:
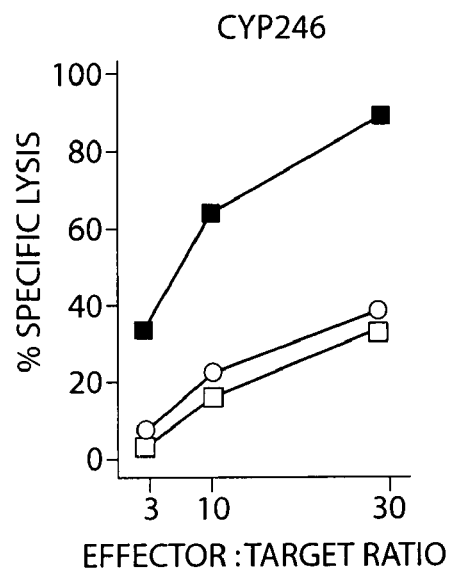
Figure 2C:
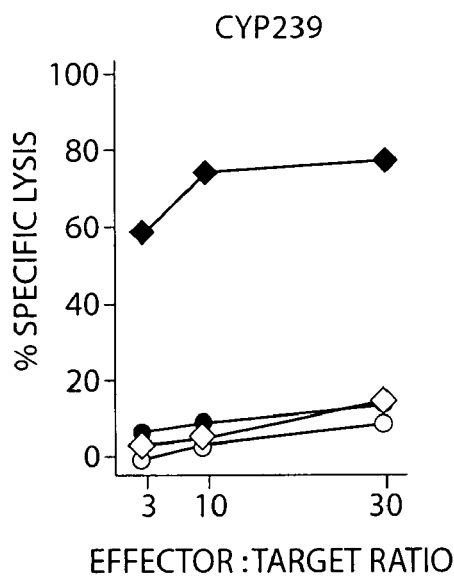
Figure 2D:
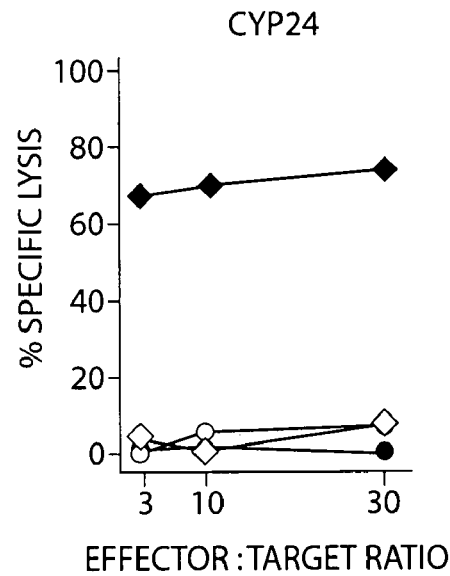

To test whether CYP239 and CYP246 reactive T cells are present in the human T cell repertoire, CTL lines were generated ex vivo by repetitive stimulation with peptide pulsed autologous APC. CTL specific for CYP239 were induced from peripheral blood mononuclear cells (PBMC) in 11 of 13 healthy HLA-A2$^+$ donors (FIG. 2A). These CTL specifically lysed T2 cells pulsed with CYP239 peptide, while no cytotoxicity occurred against unpulsed T2 cells or T2 cells pulsed with the F271 peptide from MAGE-3. CYP246 specific CTL were generated in 4 of 10 healthy HLA-A*0201$^+$ donors (FIG. 2B). HLA-A2 restriction was demonstrated using autologous and HLA-A2 mismatched CD40-activated B cells (CD40-B) as targets (FIGS. 2C and 2D). CYP239-specific CTL lysed autologous CD40-B pulsed with CYP239, but not allogeneic HLA-A2$^-$ CD40-B pulsed with CYP239 (FIG. 2C). Similar results were obtained for CYP246-specific CTL (FIG. 2D).

Figure 3:
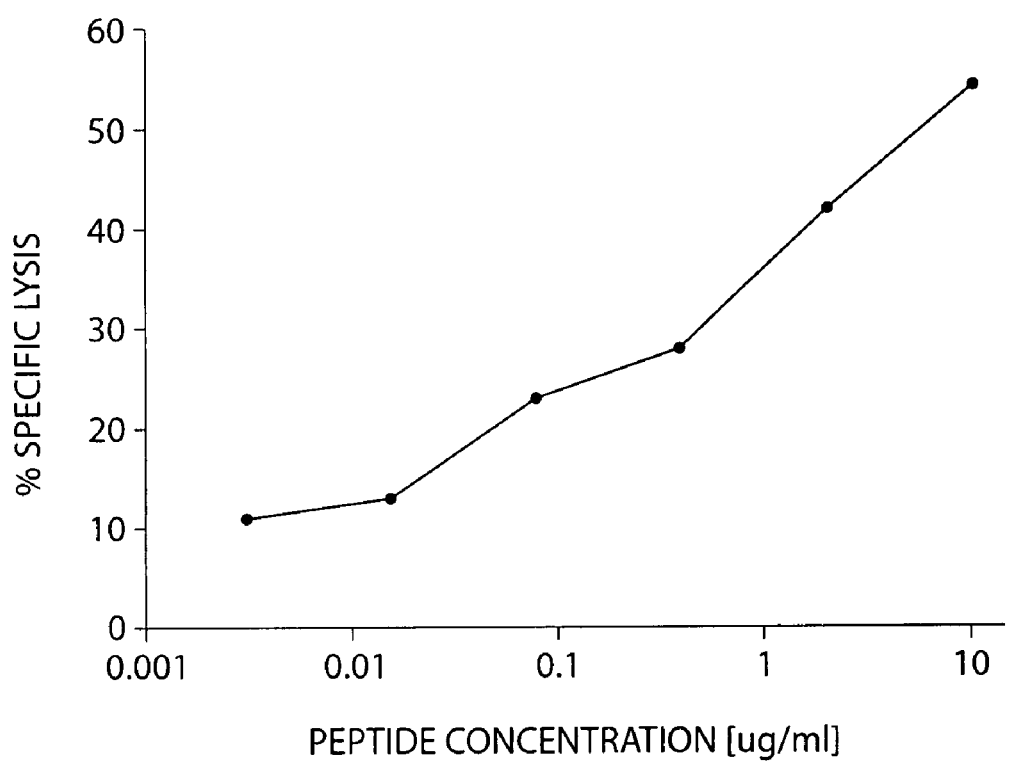
FIG. 3 is a graph showing the level of specific lysis of CD40-activated B cells that were titrated with increasing concentrations of peptide before exposure to peptide-specific CTLs.

Experiments titrating the concentration of peptide onto the CD40-activated B cells before the cytotoxicity assay further support the peptide-specificity of the CTL generated against the CYP239 peptide. Comparing the data with published data in the literature the cell line tested in this experiment is of intermediate avidity. Alternatively, the cell line contains both high and low avidity CTL and the curve represents the sum of the actions of these CTLs (FIG. 3).

Figure 2E:
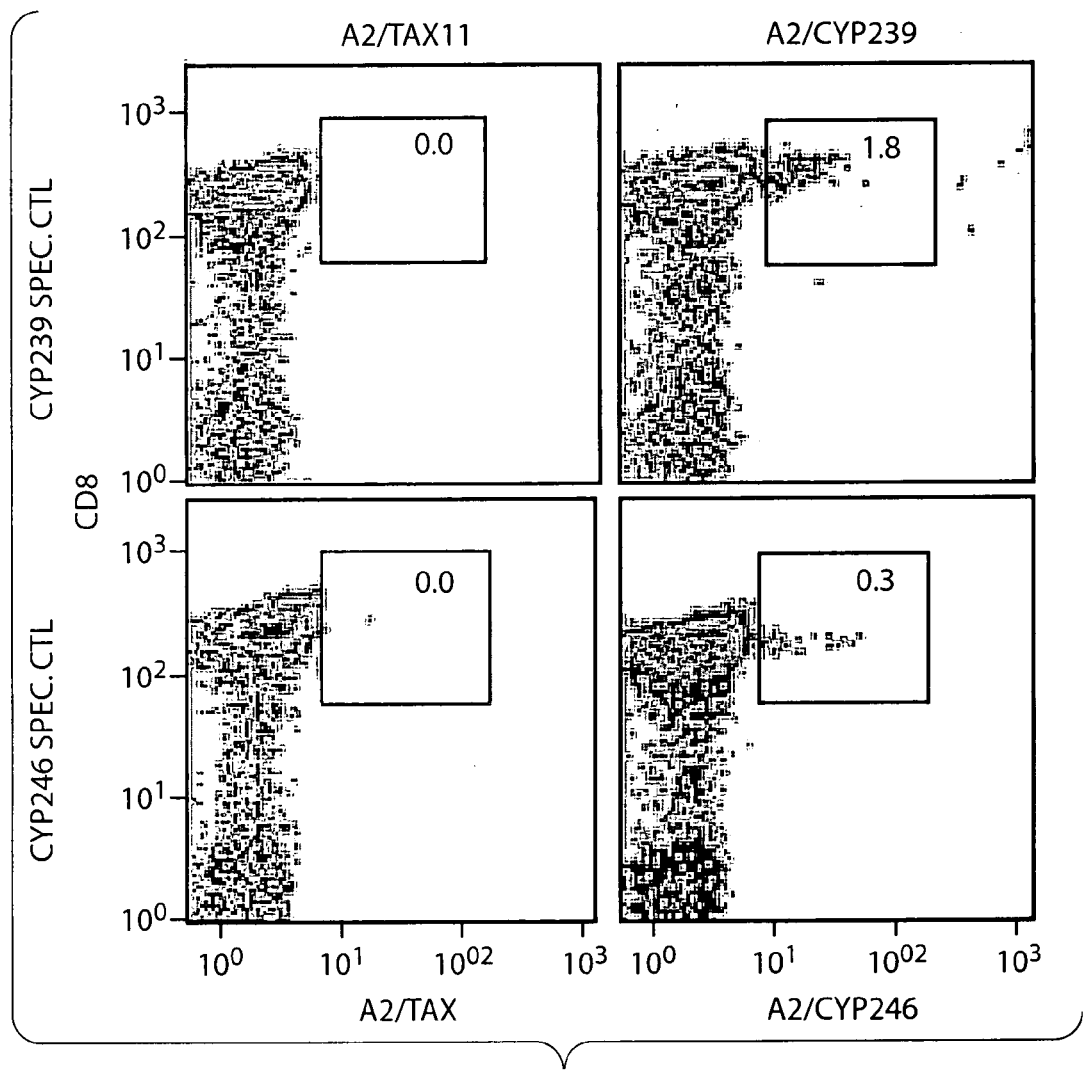
FIG. 2E is a series of graphs showing a representative tetramer analysis of CYP239- and CYP246-specific CTL after 4 weeks in culture. The A2/TAX tetramer served as a negative control. Percent tetramer+ CD8+ T cells is shown. Positive tetramer staining correlated with specific cytotoxicity in $^{51}$Cr assays.
Figure 2F:
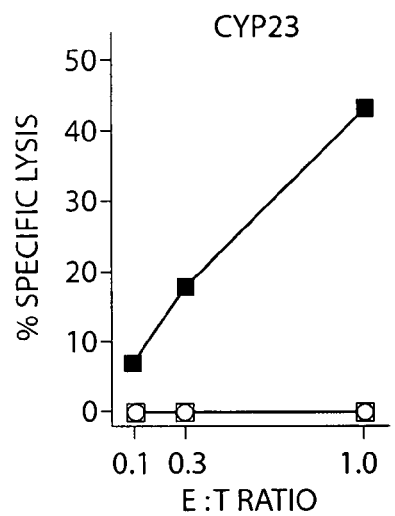
FIG. 2F is a graph showing the cytotoxicity of expanded CYP239-specific tetramer sorted CTL against T2 cells either unpulsed (□), pulsed with CYP239 (■) or RT-pol476 (○).

For both CYP239 and CYP246 CTL, specificity was further demonstrated using peptide/MHC tetramers (FIG. 2E). Frequency analysis using CYP239 tetramers demonstrated that 1.4-2.4% of all CD8$^+$ T cells recognized the CYP239 peptide, a percentage comparable to previously published data for gp100 specific (Yee et al., J. Immunol. 162:2227-2234, 1999) or proteinase-3 specific CTL lines (Molldrem et al., Cancer Res. 59:2675-268.1, 1999). CYP246-specific CTLs were detected with CYP246 tetramer, but the frequency of specific CTL was lower (0.47%). To further confirm peptide-specific cytotoxicity, CYP239 tetramer-positive CTL were sorted and expanded using phytohemagglutinin (PHA), IL-7, IL-2, and irradiated allogeneic PBMC. These CTL lysed T2 cells pulsed with CYP239 at extremely low E:T ratios, but not unpulsed T2 cells or T2 cells pulsed with an irrelevant HLA-A2 binding peptide (FIG. 2F). Thus, CYP1B1 contains at least two HLA-A*0201 binding peptides, and T cells recognizing these peptides are present in the T cell repertoire of healthy donors.

CYP1B1 Specific CTL Lyse CYP1B1 Expressing Tumors in an HLA-A2 Restricted Fashion Although peptide-specificity of CTL is demonstrated by lysis of peptide-pulsed target cells, it is important to show that tumor cells themselves process and present the peptide in the groove of their MHC molecules (Yee et al., J. Immunol. 162:2227-2234, 1999). We approached this question by using a panel of HLA-A2$^+$ and HLA-A2$^-$ tumor cell lines that all express CYP1B1 protein. CYP239- and CYP246-specific CTL from healthy donors were then screened for cytotoxicity (FIGS. 4A-4H). CYP239 CTL (FIG. 4A) and CYP246 CTL (FIG. 4B) showed specific lysis of HLA-A2$^+$ melanoma cell line K029, but not HLA-A2-SK-MEL-2 cells. Similarly, the HLA-A2$^+$ myeloma cell lines IM-9 and U266 were lysed by CYP239 CTL (FIG. 4C) and CYP246 CTL (FIG. 4D), while the HLA-A2$^-$ myeloma HS-Sultan cell line was not killed. Finally, specific cytotoxicity by CYP239 CTL (FIG. 4E) and CYP246 CTL (FIG. 4F) was observed against the HLA-A2$^+$ ovarian carcinoma cell line 36M, but not the HLA-A2$^-$ line SK-OV-3. These data show that CYP1B1 derived peptides are naturally processed and presented by tumor cell lines of different tissue origin.

Since CYP1B1 expression has been reported in fibroblasts (Eltom et al., Carcinogenesis 19:1437-1444, 1998) and monocytes (Baron et al., Biochem. Pharmacol. 56:1105-

1110, 1998), we analyzed an HLA-A2+ fibroblast cell line (GM847) and primary peripheral blood derived monocytes from four healthy donors as targets for CYP1B1-specific CTL. Western blot analysis showed that of these normal cells express low or absent levels of CYP1B1. As is shown in FIGS. 4G and 4H, CYP239 and CYP246-specific CTL failed to lyse these normal targets. In contrast, CD40-activated B cells strongly express CYP1B1 protein (detected by Western blot), but these normal cells were not lysed by CYP239- or CYP246-specific CTL (FIGS. 2C and 2D), suggesting that there is a differential expression of CYP1B peptides on tumor cells.

Methods to Improve Killing of Tumor Cell Lines

Figure 5:
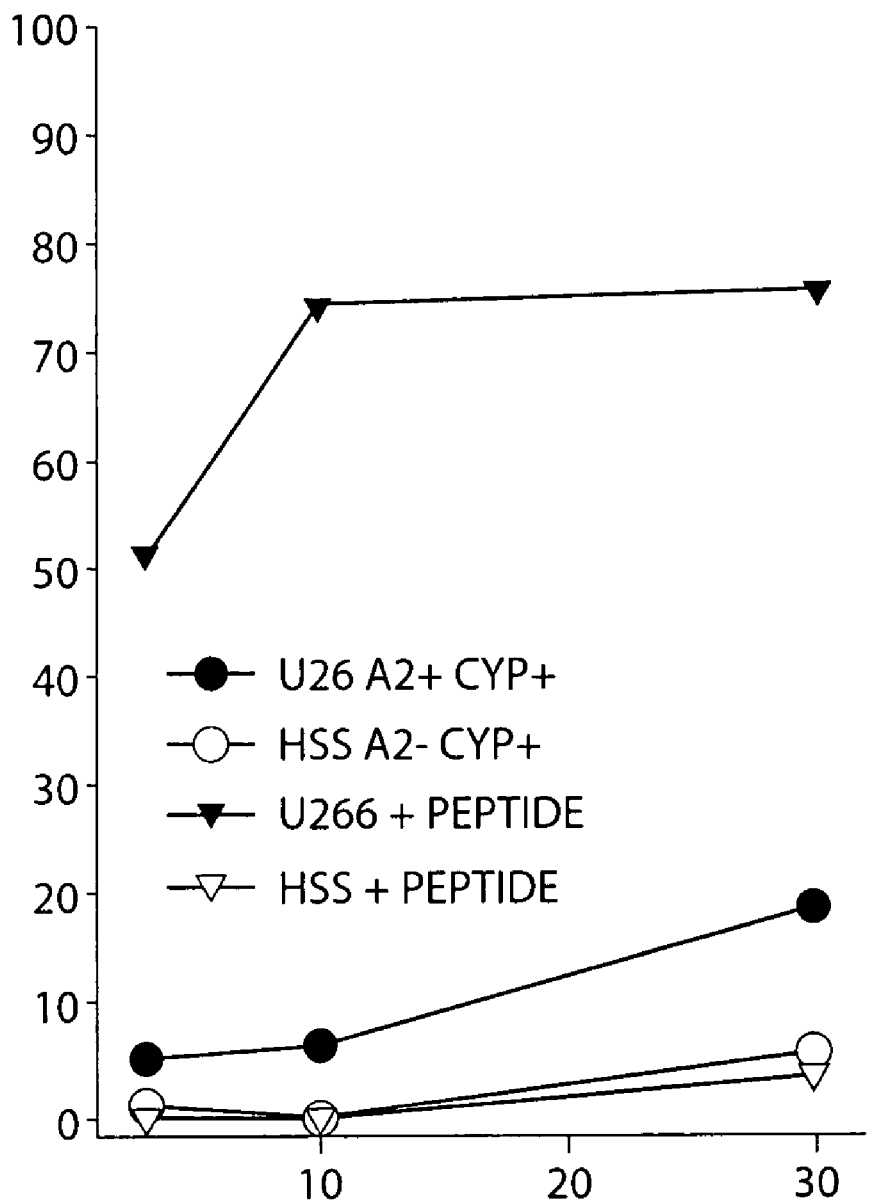
FIG. 5 is a graph showing the specific lysis of tumor cells pulsed with CYP239 by CYP239-specific CTLs.

The experiments described so far suggest that CYP239 peptide is most likely expressed at low levels on tumor cell MHC. Alternatively, tumor cells could be more resistant to CTL-mediated lysis. To address these issues and to determine whether the increase of peptide on the cell surface of tumor cells would lead to increase killing of the tumor cells, tumor cells were pulsed with the specific peptide before they were used in chromium release assays. We could demonstrate that peptide-pulsing of tumor cells significantly increased killing of the target cells, suggesting that the level of naturally expressed CYP239 peptide is low on the tumor cells, however, that these cells can be readily killed once the level of peptide is increased. This also suggests that any methodology to increase the expression of CYP1B1-derived peptides on the cell surface will make the tumor cell a susceptible target for CYP1B1-specific CTLs (FIG. 5).

Lysis of Primary HLA-A2+ Follicular Lymphoma Cells

Figures 6A, 6B:
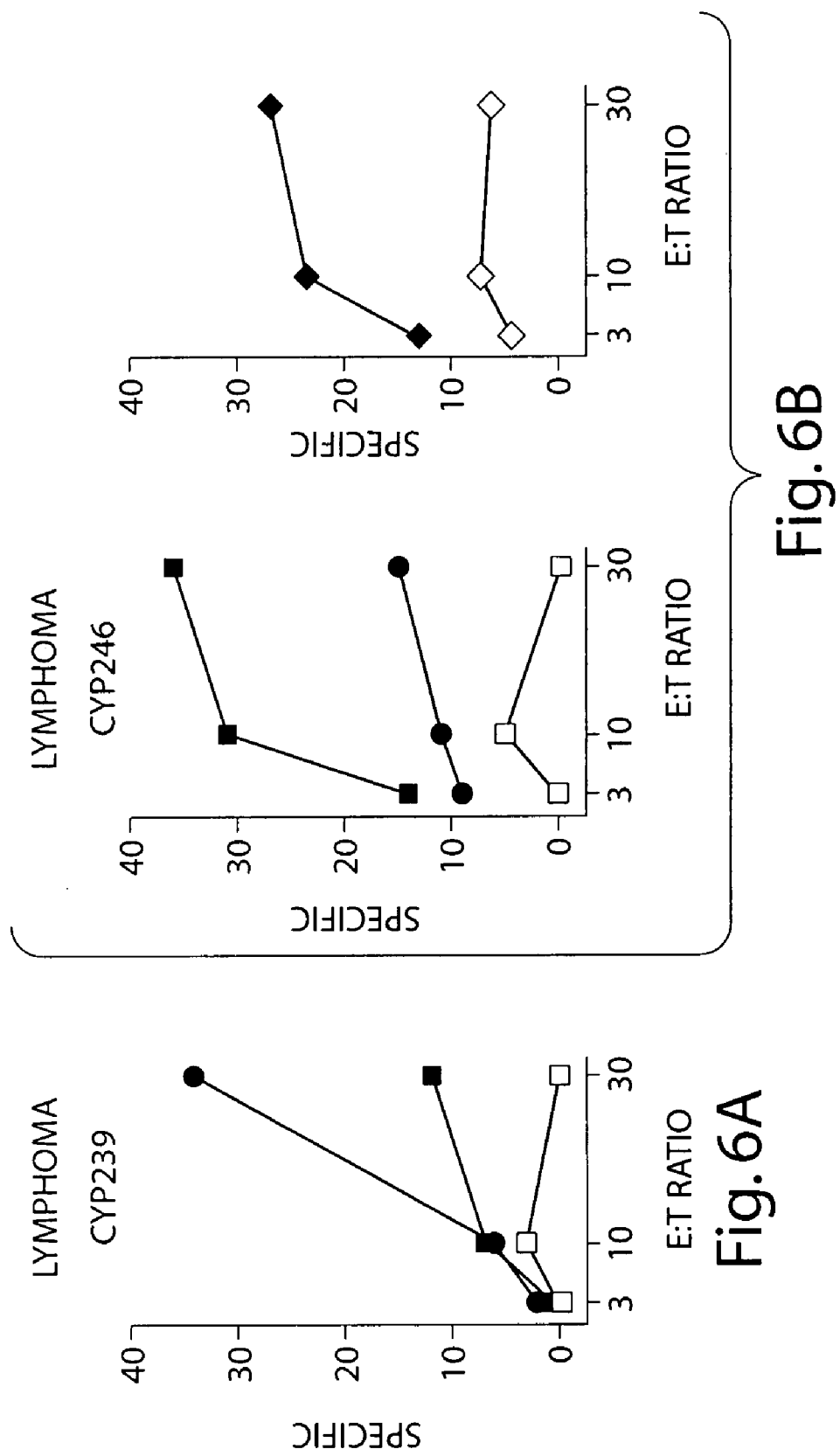

CYP1B1-specific CTLs were then evaluated for cytotoxicity against primary tumor tissue. Because CYP1B1−/− mice demonstrate a significantly reduced incidence in carcinogen-induced lymphomas (Buters et al., Proc. Natl. Acad. Sci. U.S.A. 96:1977-1982, 1999), we chose to study human primary follicular lymphoma (FL) as a model tumor target for CYP1B1 specific CTL. Tumor cells from two HLA-A2+ FL samples and one HLA-A2− FL sample were found to be CYP1B1+ as assessed by Western blot analysis. Using these target cells, we found that CTL lines generated against CYP239 or CYP246 were cytotoxic for the HLA-A2+ FL, while no killing of the HLA-A2− FL was observed (FIGS. 6A and 6B). We also demonstrated lysis of HLA-A2+ primary acute myeloid leukemia (AML) cells, but not HLA-A2− primary AML cells by CYP239 CTL (FIG. 6C). These data show that both CYP1B1-derived peptides are processed and presented by HLA-A2 on primary tumor cells and that HLA-A2 restricted CYP1B1 specific CTL from healthy donors can recognize and kill these target cells.

Generation of CYP1B1-Specific CTL from Patients with Multiple Myeloma

Figure 7A:
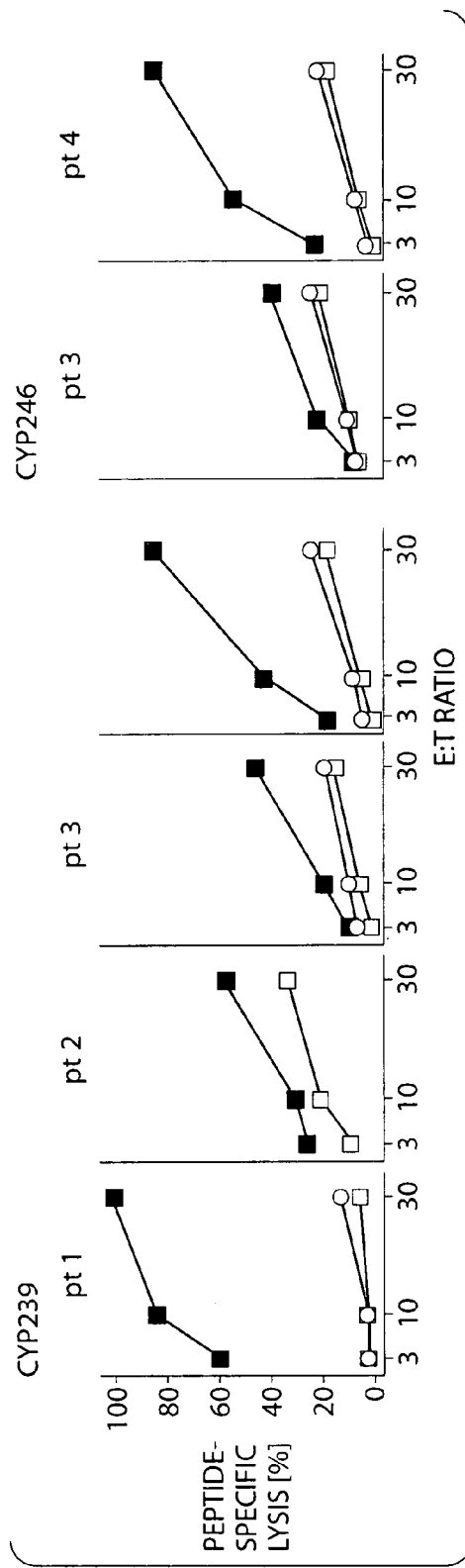
FIGS. 7A and 7B are each a series of graphs showing the generation of CYP239- and CYP246-specific CTL from cancer patients. (A) CYP239-specific CTL from 4 patients (pt 1-4) and CYP246-specific CTL from pt 3 and pt 4 lysed T2 cells pulsed with the immunizing peptide (■), but not unpulsed T2 cells (□) or T2 cells pulsed with the irrelevant F271 peptide from MAGE-3 (○). (B) The same CYP239- or CYP246-specific CTL lysed the CYP1B1+ HLA-A2+ myeloma cell lines IM-9 (♦) and U266 (●) but not the CYP1B1− HLA-A2− line HS-Sultan (◇). In two cases, IM-9 cells were not lysed. All experiments shown here were performed twice with similar results.
Figure 7B:
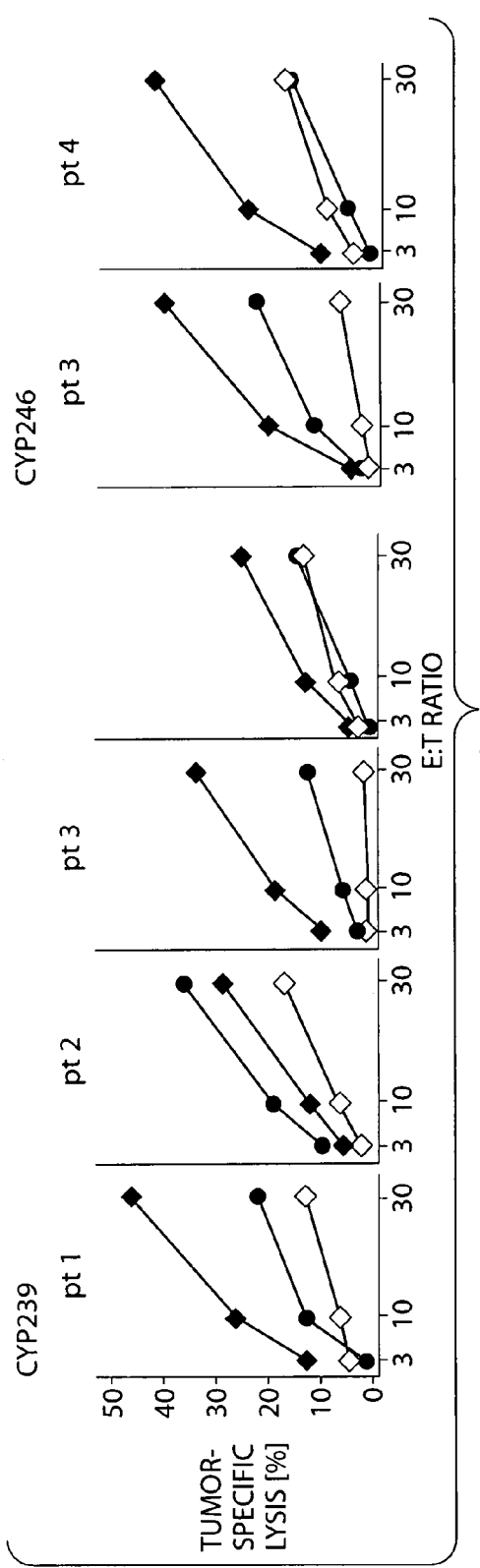

Similar to experiments described for healthy donors, we next attempted to generate CYP1B1-specific CTL from peripheral blood of cancer patients. HLA-A2+ patients with multiple myeloma (n=3) or follicular lymphoma (n=1) (Table 2) were tested for ex vivo generation of CYP239 (n=4) or CYP246 (n=2) specific CTL. Generation of all cellular components of our ex vivo system (i.e., dendritic cells, CD40-B, and CTL), as well as expansion of CTL to CYP239 and CYP246 were similar to results obtained for healthy donors. Using peptide-pulsed T2 cells as targets, we demonstrated CYP239-specific CTL in all four patients (FIG. 7A). Due to lower numbers of PBMC available, CYP246-specific CTL cultures were only initiated in patients 3 and 4. CYP246-specific CTLs were detected in both patients. These patient-derived lines showed tumor-specific lysis of HLA-A2+ myeloma cell lines U266 and IM-9, but not the HLA-A2− myeloma cell line HS-Sultan (FIG. 7B). Because autologous tumor cells were not available from these patients, we tested the same FL samples described above as primary tumor targets. CYP239-specific CTL from patient 1 lysed both HLA-A2+ FL samples but not the HLA-A2− (18% vs. 0% at an E:T ration of 30:1).

TABLE 2

Patient characteristics, prior treatment, and CTL induction

| patient | age | sex | disease | stage | prior treatment | CTL induction | |
|---------|-----|-----|---------|-------|-----------------|---------------|---|
| | | | | | | CYP239 | CYP246 |
| 1 | 41 | f | Multiple Myeloma | I A | none | yes | ND |
| 2 | 47 | f | Multiple Myeloma | II A | none | yes | ND |
| 3 | 40 | m | Multiple Myeloma | III A | High-Dose Dexamethasone, discontinued >30 d prior to leukapheresis | yes | yes |
| 4 | 29 | m | Non Hodgkin's Lymphoma (Follicular Lymphoma) | III A | none | yes | yes |

ND = not determined

Combining CYP1B1— and hTERT-Specific CTL

Figure 8:
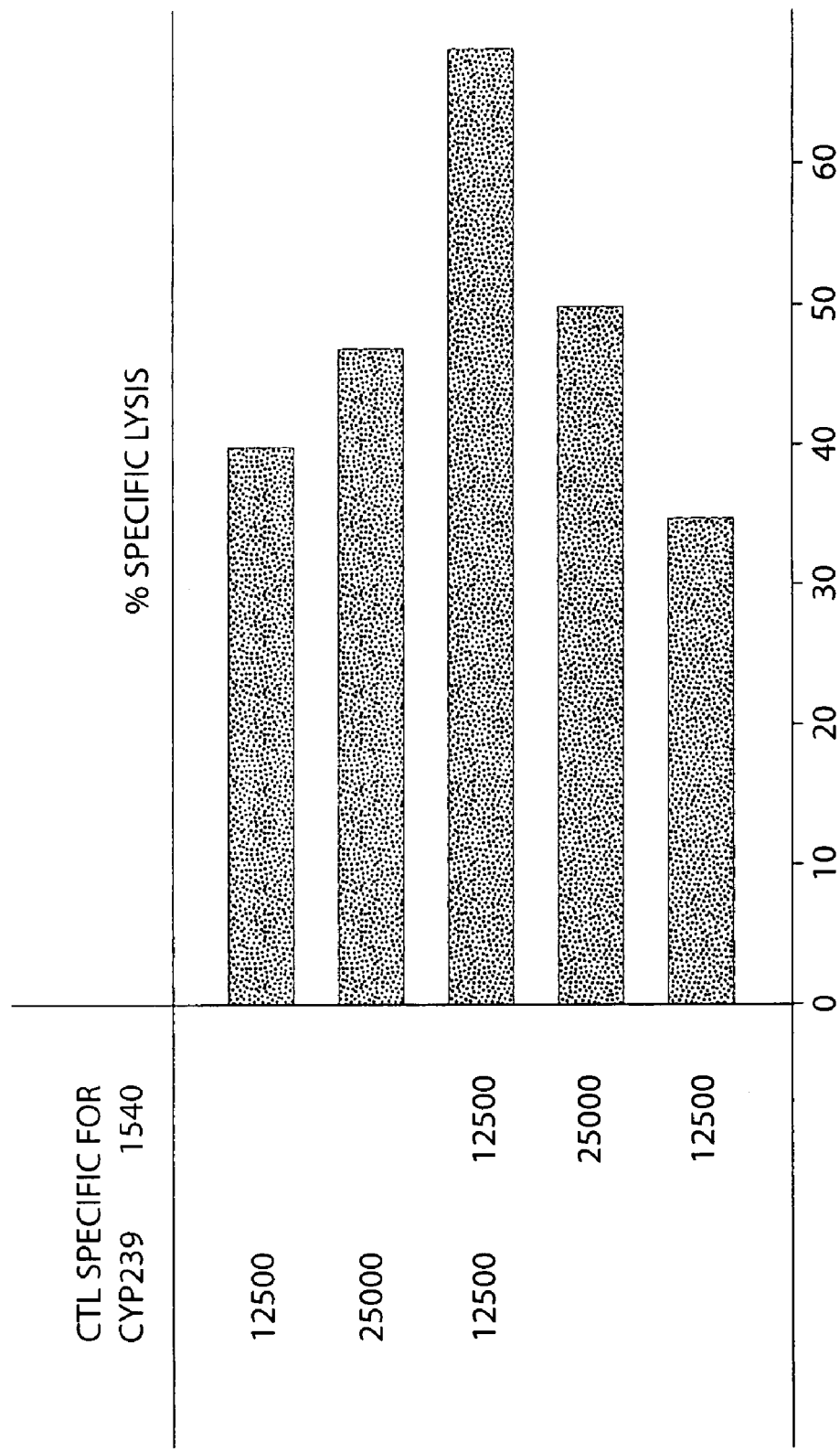
FIG. 8 is a graph showing that the efficacy of a combination of CYP1B1 and hTERT-specific CTL in a chromium release assay. CYP239- and 1540-specific CTL were used individually or in combination against a mixture of T2 cells pulsed with either CYP239 or 1540 peptide. Target cells were mixed at a 1:1 ratio using a final number of 5000 cells/well. Numbers shown reflect the number of effector cells added to each well.

We next analyzed the combination of CYP 1B1-specific CTL with hTERT-specific CTL (Vonderheide et al., Immunity 10:673-679, 1999). To normalize for equal susceptibility to T-cell mediated lysis, we used a mixture (1:1 ratio) of T2 cells pulsed with either CYP239 or I540 hTERT peptide (Vonderheide et al., Immunity 10:673-679, 1999) as a model for heterogeneous antigen expression. Equal $^{51}$Cr labeling of both T2 cell populations was assured. Under these conditions, it is expected that either CTL line alone can only lyse a maximum of 50% of the target cell population while the combination if effective has the potential to kill >50% of all cells (Janeway, Immunobiology: The Immune System in Health and Disease (Garland Publishing c/o Taylor & Francis, Inc., N.Y., 1999), p. 297). This is true for specific lysis regardless of the E:T ratio used. As postulated, the combination of CYP239- and I540-specific CTL was superior to each CTL line alone, achieving specific lysis of >50% (FIG. 8). Similar observations were made in independent experiments using CTL generated from two different donors. We also analyzed the effect of combined CYP1B1 and hTERT CTL on the HLA-A2+ tumor cell line IM-9, which expresses both antigens. In two experiments, we observed additive lysis of CYP239- and I540-specific CTL across a range of E:T ratios.

These data demonstrate the potential of enhancing antigen-specific T cell immunity by targeting multiple antigens, such as CYP1B1 and hTERT.

Use of Heteroclitic Peptides

Figure 9:
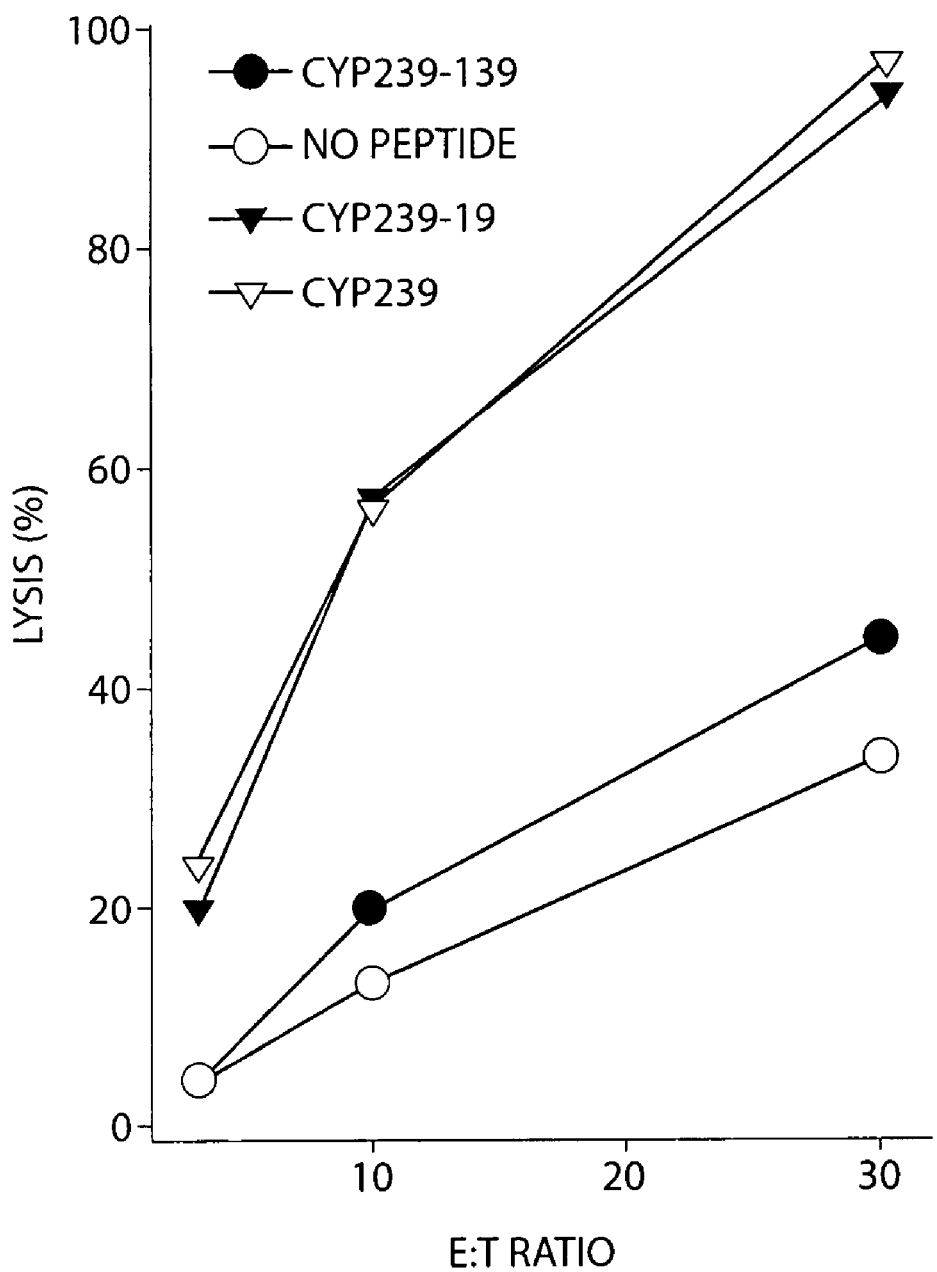
FIG. 9 is a graph showing the specific lysis of target cells with CTLs specific for heteroclitic peptides CYP239-19 and CYP239-139.

To improve immunogenicity of CYP1B1 derived peptides, we designed heteroclitic peptides optimized for binding affinity to MHC. We have already shown that CTL generated against the CYP239 wild type peptide can recognize and lyse target cells pulsed with the heteroclitic peptide CYP239-19 equally well, while CTL generated with CYP239 do not recognize CYP239-139. These data show that despite similar binding, the change of a third amino acid does not allow for recognition by CTL specific for CYP239. Most likely, the amino acid change induced a change in the three dimensional structure of the peptide not allowing TCR activation (FIG. 9). To design heteroclitic peptides with higher binding affinity, we used an algorithm available on the Internet. Two heteroclitic peptides to the immunogenic peptide CYP239 have been designed as examples to improve binding affinity, complex stability, and potentially, immunogenicity (Table 3).

TABLE 3

Examples of Heteroclitic Peptides Optimized for Binding to HLA-A*0201
Heteroclitic 9mers

| Position | Peptide | nmer | Parker score | Zhiping score | T2 assay result |
|---|---|---|---|---|---|
| 292 | YLYAFILSV (SEQ ID NO: 8) | 9 | 8948.1 | −0.99 | n.d. |
| 344 | YLYTRYPDV (SEQ ID NO: 9) | 9 | 1535.7 | 0.7 | n.d. |
| 380 | YLYAFLYEV (SEQ ID NO: 10) | 9 | 8948.1 | −3.51 | n.d. |
| 246 | YLYYFPNPV (SEQ ID NO: 11) | 9 | 3890.5 | −0.27 | n.d. |
| 239 (1, 3, 9) | YLYDVMPWV (SEQ ID NO: 12) | 9 | 53099.7 | −3.42 | 2.00 |
| 239 (1, 9) | YLVDVMPWV (SEQ ID NO: 13) | 9 | 16593.6 | −0.85 | 2.16 |
| 239 (1, 3) | YLYDVMPWL (SEQ ID NO: 14) | 9 | 16309.2 | −1.76 | n.d. |
| 239 (3, 9) | SLYDVMPWV (SEQ ID NO: 15) | 9 | 11543.4 | −1.35 | n.d. |
| 239 (1, 3, 9) | YLVDVMPWL (SEQ ID NO: 16) | 9 | 5096.6 | 0.81 | n.d. |
| 239 (1) | SLVDVMPWV (SEQ ID NO: 17) | 9 | 3607.3 | 1.22 | n.d. |
| 239 (9) | SLYDVMLPWL (SEQ ID NO: 18) | 9 | 3545.5 | 0.31 | n.d. |

Peptide Binding of Heteroclitic CYP239 Peptides

The T2 assay described above was used to determine binding and dissociation rate of heteroclitic peptides engineered for optimal binding to HLA molecules. Two heteroclitic peptides to CYP239 were tested and shown to have higher peptide/MHC-complex stabilities, as is shown in Table 4. While the control peptide MAGE-3 and the CYP239 peptide showed no significant binding at 24 hours (0.14 resp. 0.12), both heteroclitic peptides still bound to HLA-A*0201 (0.72 resp. 0.73).

TABLE 4

Examples of heteroclitic peptides optimized for binding to HLA-A*0201

| Time post-pulsing [hours] | | 0 | 2 | 4 | 6 | |
|---|---|---|---|---|---|---|
| MAGE-3 | FLWGPRALV (SEQ ID NO: 19) | 1.88 | 1.41 | 0.93 | 0.77 | 0.14 |
| CYP239 | SLVDVMPWL (SEQ ID NO: 20) | 1.91 | 1.37 | 0.78 | 0.58 | 0.12 |
| CYP239-19 | YLVDVMPWV (SEQ ID NO: 21) | 2.16 | 1.57 | 1.31 | 1.13 | 0.72 |
| CYP239-139 | YLYDVMPWV (SEQ ID NO: 22) | 2.00 | 1.51 | 1.24 | 1.16 | 0.73 |

The following Tables 5 and 6 show predicted mutations to improve HLA-A2 binding of CYP1B1 239 and CYP1B1 246.

TABLE 5

Predict Mutations to Improve HLA-A2 Binding CYP239
Under each position, a list of possible amino acid mutations is given, followed by the change in the predicted In(IC50) produced by the mutation with respect to the original peptide's score.

POSITION

| 1 | 2 | 3 | 4 | 5 | 6 | 7 | 8 | 9 |
|---|---|---|---|---|---|---|---|---|
| K(0.17) | * | A(1.31) | | | | | | A(0.60) |
| M(2.03) | | C(1.35) | | | | | | I(1.36) |
| F(0.60) | | G(0.57) | | | | | | V(1.66) |
| Y(2.07) | | H(0.78) | | | | | | |
| | | L(1.63) | | | | | | |
| | | M(2.00) | | | | | | |
| | | F(1.40) | | | | | | |
| | | P(0.19) | | | | | | |
| | | S(0.55) | | | | | | |
| | | W(1.38) | | | | | | |
| | | Y(2.57) | | | | | | |

*indicates best amino acid is already present
Original peptide: SLVDVMPWL (SEQ ID NO: 23), predicted In(IC50) = 2.88
Top scoring peptide under given constraints: YLYDVMPWV (SEQ ID NO: 24) predicted In(IC50) = 3.42

TABLE 6

Predict Mutations to Improve HLA-A2 Binding CYP246
Under each position, a list of possible amino acid mutations is given, followed by the change in the predicted In(IC50) produced by the mutation with respect to the original peptide's score.

POSITION

| 1 | 2 | 3 | 4 | 5 | 6 | 7 | 8 | 9 |
|---|---|---|---|---|---|---|---|---|
| A(1.53) | * | A(1.50) | | | | | | * |
| R(1.08) | | D(0.10) | | | | | | |
| N(0.33) | | C(1.54) | | | | | | |
| C(0.88) | | G(0.76) | | | | | | |
| G(1.39) | | H(0.97) | | | | | | |
| L(0.92) | | I(0.16) | | | | | | |
| K(1.84) | | L(1.82) | | | | | | |
| M(3.70) | | M(2.19) | | | | | | |
| F(2.27) | | F(1.59) | | | | | | |
| S(1.67) | | P(0.38) | | | | | | |
| T(0.94) | | S(0.74) | | | | | | |
| Y(3.74) | | W(1.57) | | | | | | |
| V(1.21) | | Y(2.76) | | | | | | |
| | | V(0.19) | | | | | | |

*indicates best amino acid is already present
Original peptide: WLQYFPNPV (SEQ ID NO: 25), predicted In(IC50) = 6.23
Top scoring peptide under given constraints: YLYYFPNPV (SEQ ID NO: 26) predicted In(IC50) = −0.27

Identification of Additional HLA-A2 Binding Epitopes from CYP1B1

Binding studies were carried out to characterize additional CYP1B1-derived peptides that are predicted to bind to HLA-A2. Table 7, below, shows the sequences of additional peptides that are predicted to bind to HLA-A2.

TABLE 7

| position | Peptide | Parker Score | LPpep Rank | LPpep Score | SYFPEITHI Rank | SYFPEITHI Score | rank |
|---|---|---|---|---|---|---|---|
| Predicted binding of epitopes to HLA-A2 | | | | | | | |
| Nonamers predicted to bind to HLA-A*0201 | | | | | | | |
| 25 | LLLSVLATV (SEQ ID NO: 27) | 1006 | 3 | 3.54 | 4 | 32 | 1 |
| 88 | RLGSCPIVV (SEQ ID NO: 28) | 29 | 18 | 4.61 | 6 | 20 | 31 |
| 190 | FLDPRPLTV (SEQ ID NO: 29) | 128 | 11 | 6.52 | 15 | 26 | 5 |
| 239 | SLVDVMPWL (SEQ ID NO: 30) | 1108 | 2 | 2.88 | 2 | 24 | 9 |
| 246 | WLQYFPNPV (SEQ ID NO: 31) | 1216 | 1 | 6.23 | 12 | 21 | 22 |
| 292 | MMDAFILSA (SEQ ID NO: 32) | 21 | 19 | 3.31 | 3 | 20 | 29 |
| 344 | LLFTRYPDV (SEQ ID NO: 33) | 656 | 4 | 4.69 | 7 | 24 | 7 |
| 377 | LCPYVLAFL (SEQ ID NO: 34) | 270 | 8 | 7.1 | 21 | 25 | 6 |
| 380 | YVLAFLYEA (SEQ ID NO: 35) | 65 | 14 | 1.56 | 1 | 20 | 27 |
| 479 | QLFLFISIL (SEQ ID NO: 36) | 283 | 6 | 5.66 | 9 | 26 | 4 |
| 528 | LLDSAVQNL (SEQ ID NO: 37) | 33 | 16 | 4.08 | 5 | 26 | 3 |
| Table 1a | | | | | | | |
| Decamers predicted to bind to HLA-A*-0201 | | | | | | | |
| 24 | LLLSVLATV (SEQ ID NO: 38) | 1006 | 1 | 4.55 | 5 | 24 | 1 |
| 88 | RLGSCPIWL (SEQ ID NO: 39) | 20 | 22 | 3.08 | 2 | 26 | 3 |
| 343 | LLLFTRYPDV (SEQ ID NO: 40) | 656 | 2 | 5.6 | 9 | 343 | 7 |
| 477 | KMQLFLFISI (SEQ ID NO: 41) | 50 | 13 | 1.29 | 1 | 19 | 31 |
| 479 | QLFLFISILA (SEQ ID NO: 42) | 18 | 24 | 3.86 | 3 | 15 | 67 |
| 486 | ILAHQCDFRA (SEQ ID NO: 43) | 49 | 14 | 3.87 | 4 | 18 | 36 |
| Table 1b | | | | | | | |

Figure 10:
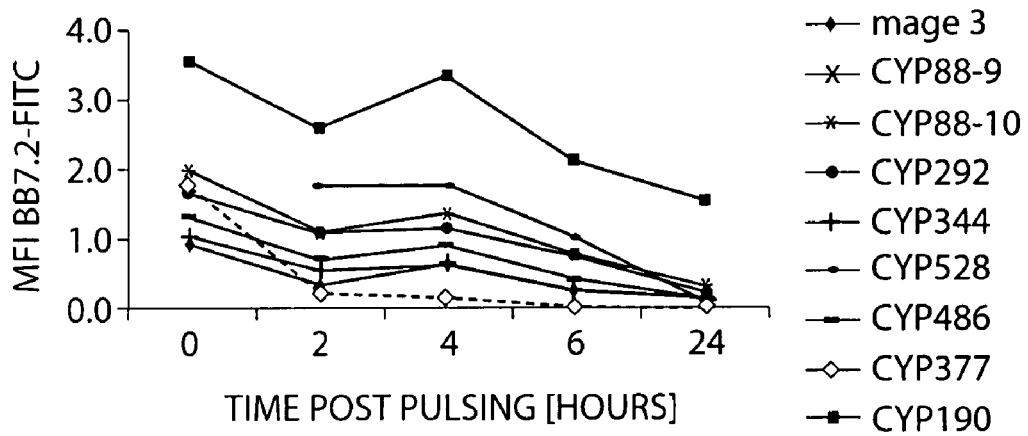
FIG. 10 is a graph showing the stability of HLA-A2/peptide complexes including the indicated peptides, as determined by TAP-deficient T2 cell assays.
Figure 11:
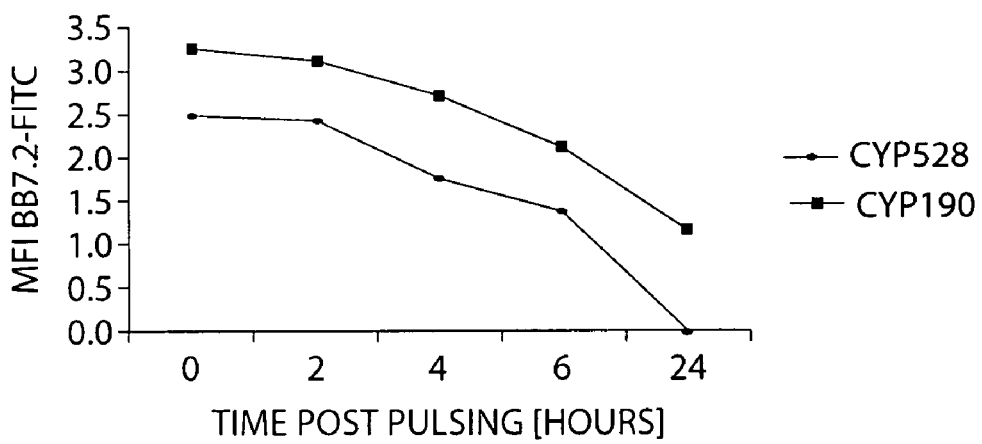
FIG. 11 is a graph showing the stability of HLA-A2/peptide complexes including CYP190 and CYP528, as determined by TAP-deficient T2 cell assays.
Figure 12A:
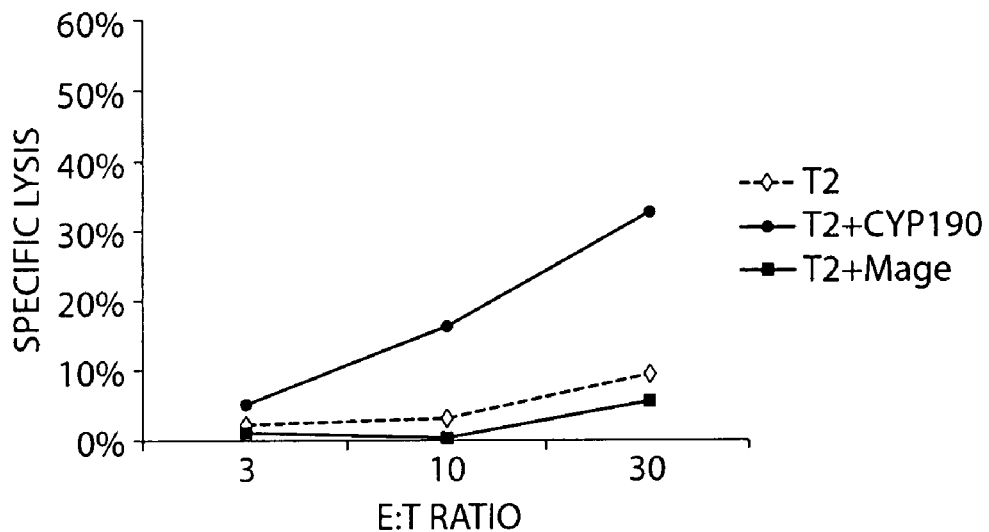
FIGS. 12A-12C are graphs showing that CYP190-specific CTL lyse peptide-pulsed T2 cells (A), HLA-A2+ myeloma cell lines: IM-9, U266, and HS-Sultan (HSS) (B), and HLA-A2+ primary Acute Lymphoblastic Leukemia (ALL) cells (C), while CTL do not lyse HLA-A2− cells (C).
Figure 12B:
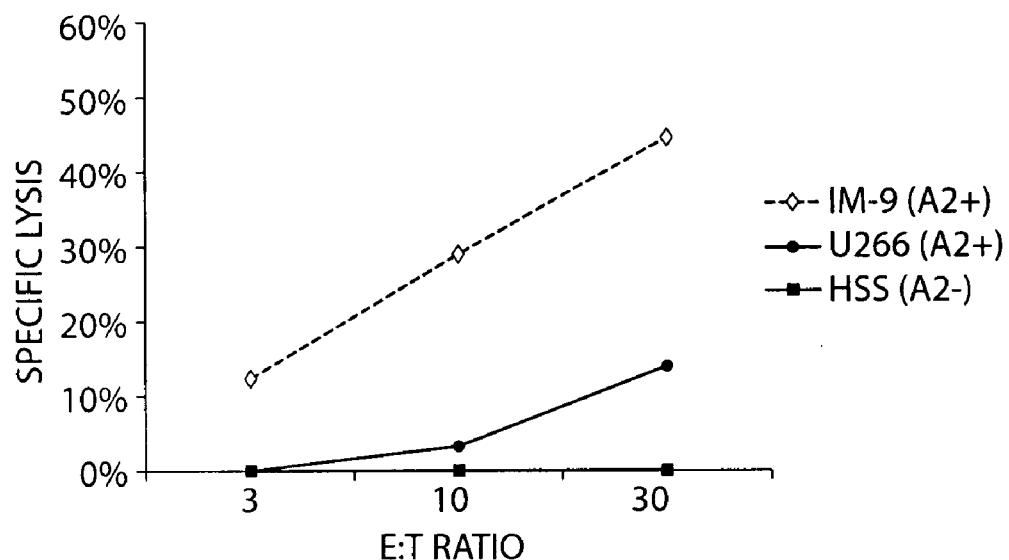
Figure 12C:
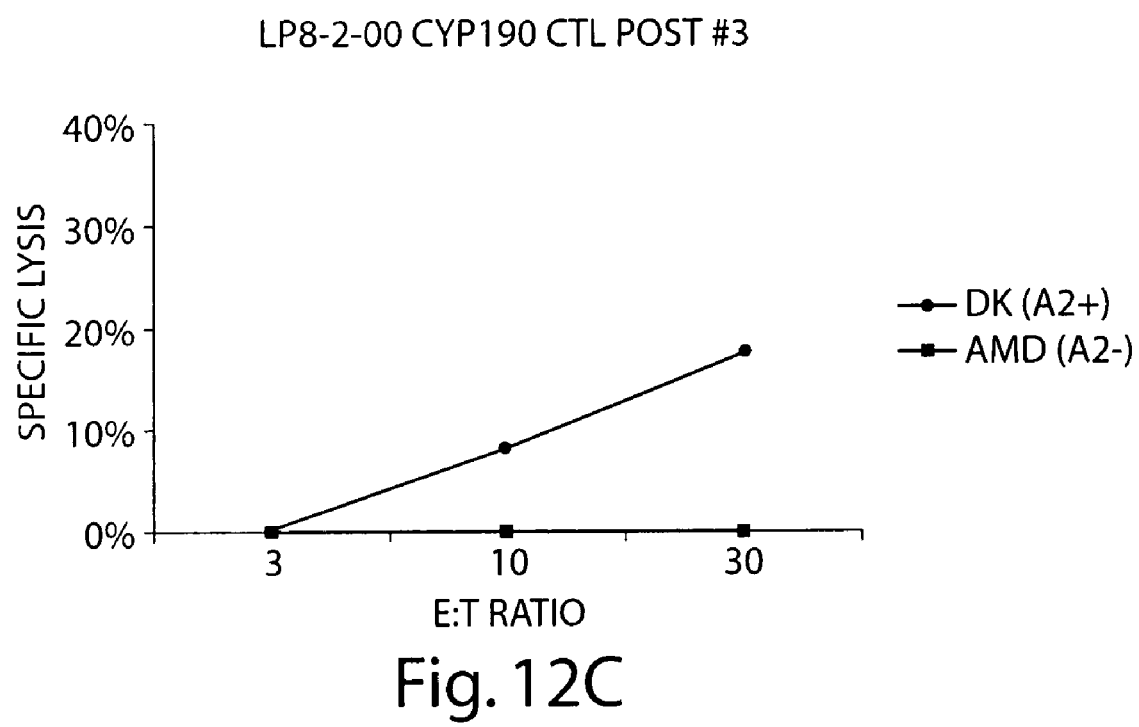
Figure 13A:
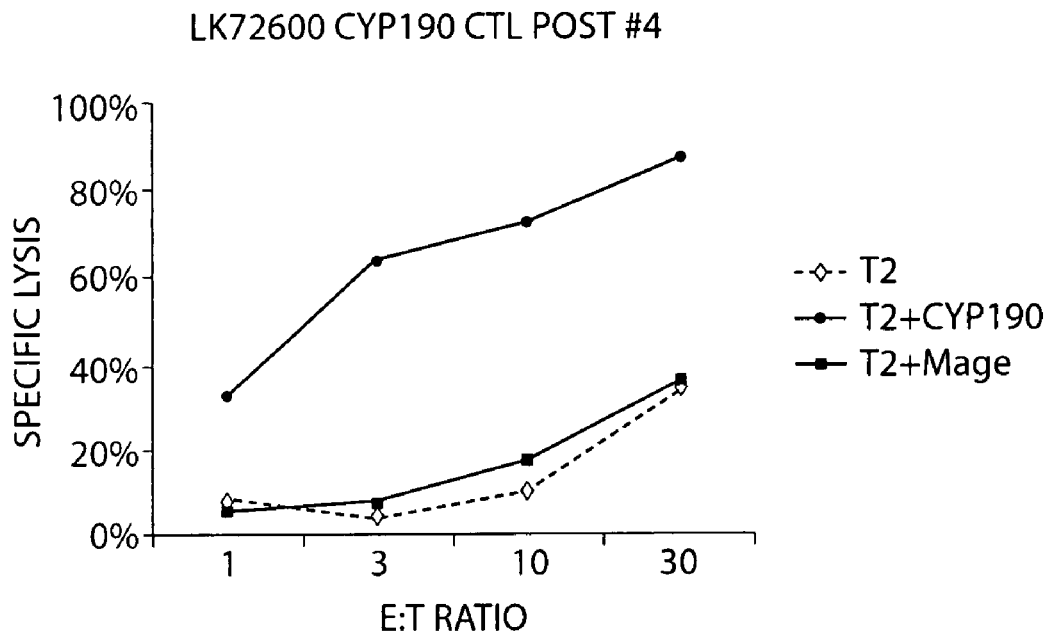
FIGS. 13A and 13B are graphs showing that CYP190-specific CTL can be generated from cancer patients, such as a (A) prostate cancer patient (HLA-A2+), and (B) a multiple myeloma patient (HLA-A2+).
Figure 13B:
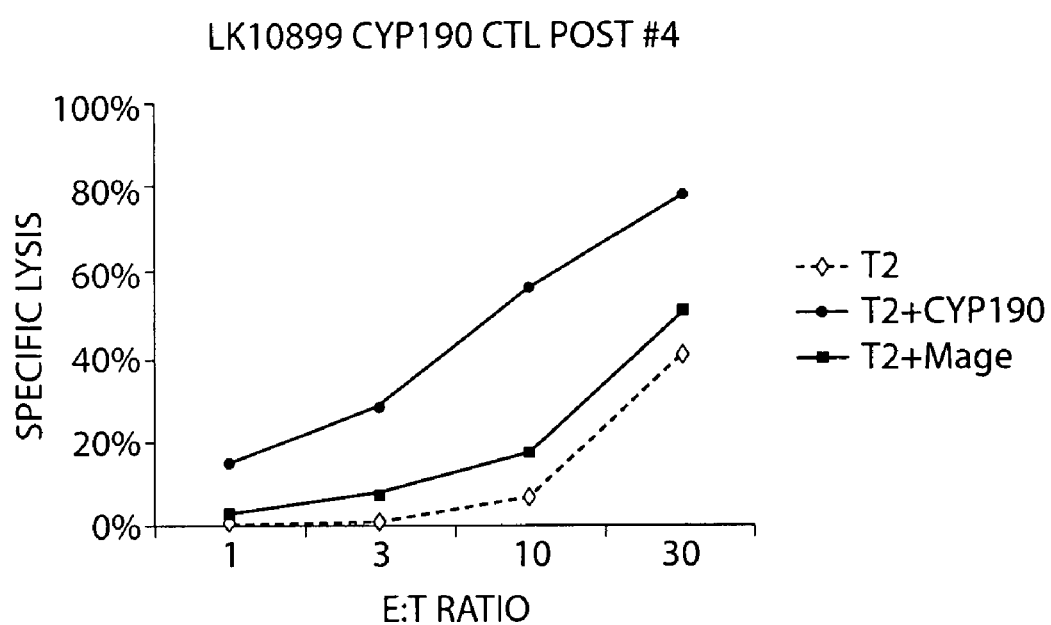

Peptides were pulsed onto TAP-deficient T2 cells, and the maximum binding and the stability over time were assessed by flow cytometry. As is shown in FIG. 10, CYP190 and CYP528 show the longest half-life on the cell surface. Additional experiments were carried out to characterize these peptides, in particular, CYP190. As is shown in FIG. 11, further binding studies using TAP-deficient T2 cells showed that CYP190/A2 complexes can be detected as long as 24 hours after peptide withdrawal. Moreover, as is shown in FIGS. 12A-12C, CYP190-specific CTL can be generated from normal HLA-A2+ donors, and these CTL can lyse peptide-pulsed T2 cells (FIG. 12A), HLA-A2+ myeloma cell lines (FIG. 12B), and HLA-A2+ primary ALL cells (FIG. 12C). In addition, as is shown in FIGS. 13A and 13B, CYP190-specific CTL can be generated from HLA-A2+ cancer patients (FIG. 13A, prostate cancer patient, and FIG. 13B, multiple myeloma patient), and show specific lysis.

We also identified HLA-A3 binding epitopes from CYP1B1. Using the BIMAS server, for example, we identified the peptides shown in Table 8, in which the positive control is a peptide derived from influenza A.

TABLE 8

Peptides predicted to bind to HLA-A3 (BIMAS server)

| rank | Position | Sequence | Score |
|---|---|---|---|
| 10mers | | | |
| 1 | 508 | GLTIKPKSFK (SEQ ID NO: 44) | 90 |
| 2 | 445 | FLDKDGLINK (SEQ ID NO: 45) | 60 |
| 3 | 450 | GLINKDLTSR (SEQ ID NO: 46) | 27 |
| 9MERS | | | |
| 1 | 150 | SMMRNFFTR (SEQ ID NO: 47) | 54 |
| 2 | 408 | SVLGYHIPK (SEQ ID NO: 48) | 27 |
| Positive control | NP265 | ILRGSVAHK (SEQ ID NO: 49) | 90 |

As is shown in Table 9, these peptides were tested in a binding assay to T2 cells transfected with HLA-A3 (NP265=positive control from influenza A). These studies showed that CYP408, CYP445, and CYP 150, which are not homologous to other cytochrome P450 isoenzymes, repeatedly bound to HLA-A3.

TABLE 9

Binding assay of peptides to T2 cells transfected with HLA-A3

| peptide | FI class I | FI |
|---|---|---|
| PBS | 15.3 | |
| NP265 | 19.4 | 0.27 |
| CYP508 | 16.4 | 0.07 |
| CYP408 | 16.9 | 0.10 |
| CYP445 | 19.5 | 0.27 |
| CYP450 | 16.8 | 0.10 |
| CYP150 | 17.2 | 0.12 |
| Flu-MP58 | 34.8 | 1.27 |

Figure 14:
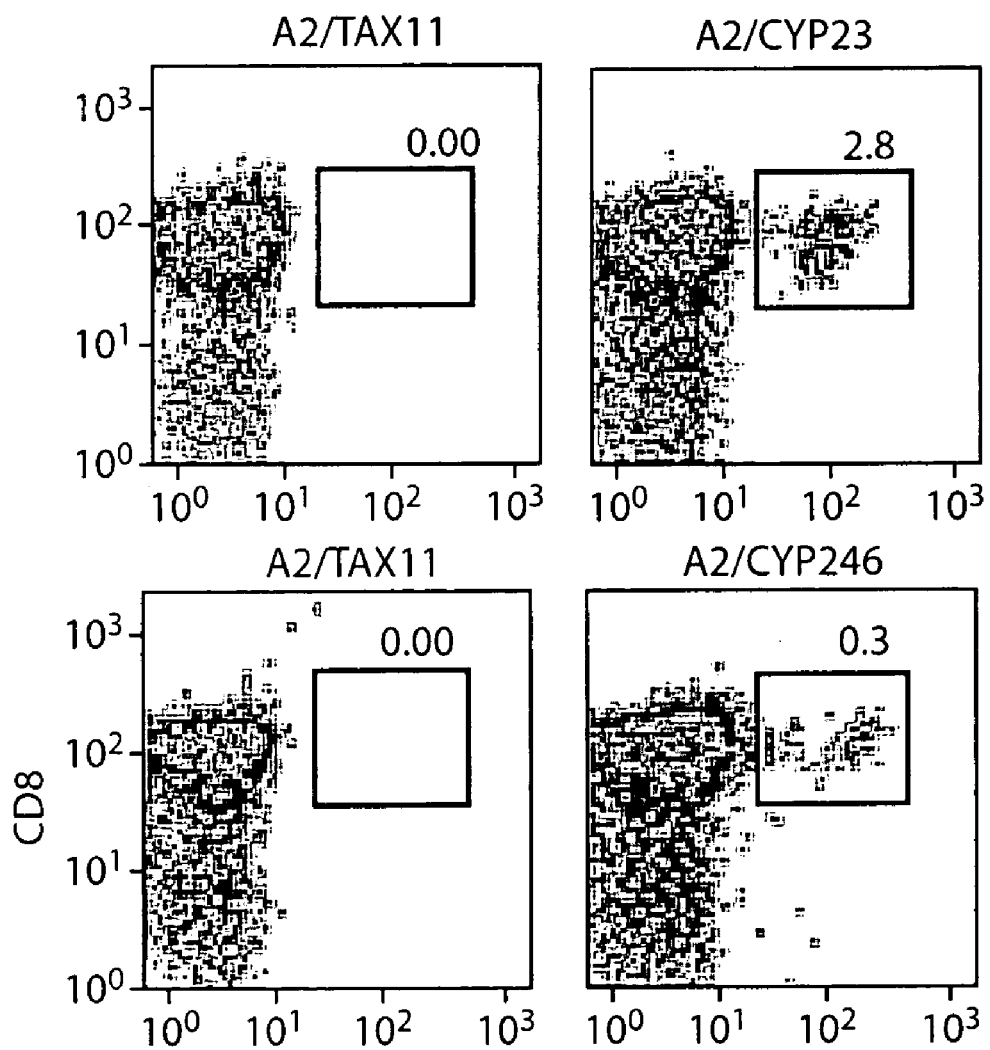
FIG. 14 is a graph showing the generation and verification of CYP1B1-specific tetramers including CYP239, CYP246, or a control, Tax 11.

In further studies, we detected CYP1B1 reactive T cells in HLA-A2+ normal donors HLA-A2+ cancer patients (FIG. 14). Specific binding of tetramers with CYP239 and CYP246 peptides was confirmed on T cell lines generated against the respective peptide. No binding could be detected on T cells generated against an irrelevant peptide. A tetramer containing a peptide from HTLV was used as a negative control.

Figure 15:
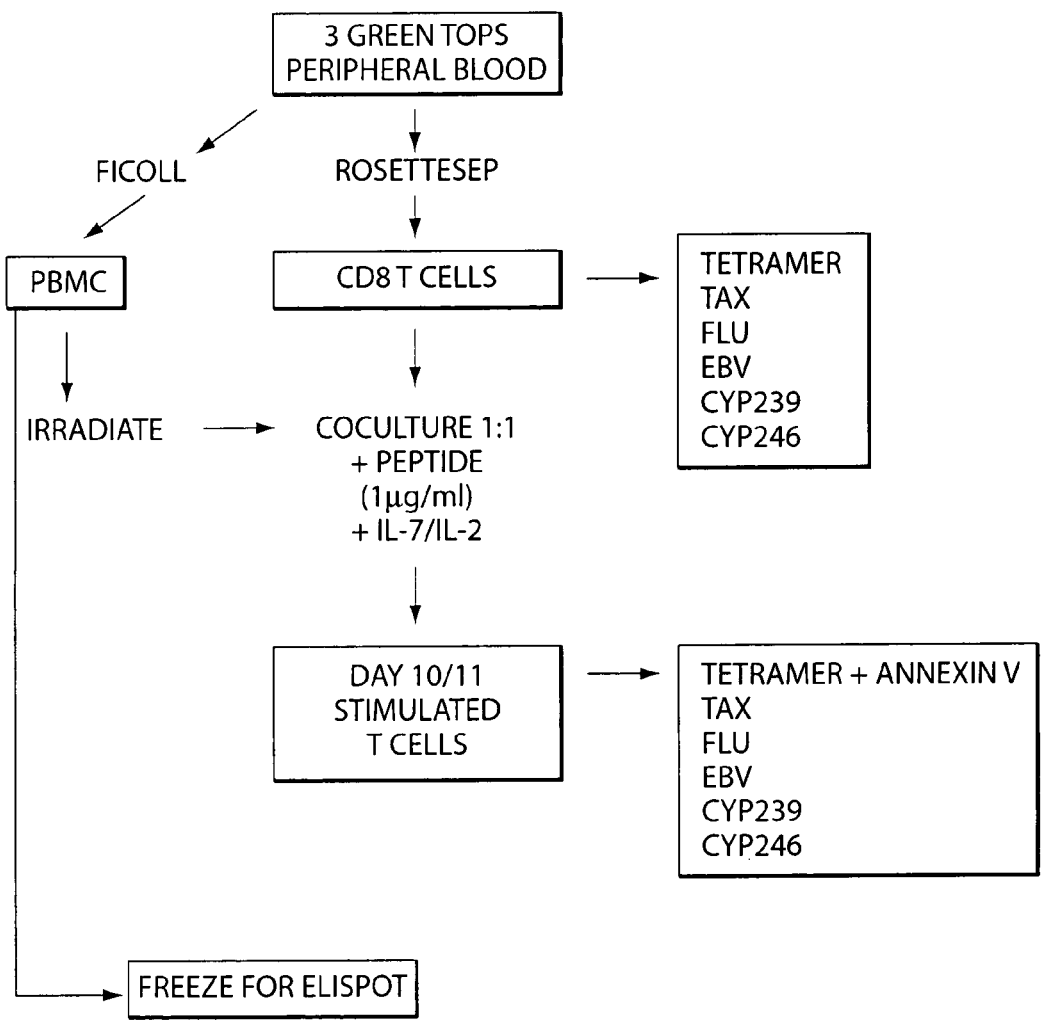
FIG. 15 is a schematic representation of a system to detect CYP1B1 T cells by HLA-A2/peptide tetrameric complexes.

We also devised a system for detecting CYP1B1-specific T cells by HLA-A2/peptide tetrameric complexes, as is illustrated in FIG. 15. CD8+ T cells from normal HLA-A2+ myeloma patients (n=1°) were isolated and analyzed with HLA-A2/peptide tetrameric complexes directly ex vivo and after a 10 day in vitro restimulation period with peptide, cytokines, and irradiated PBMC. Viral peptides were used as positive (influenza A, EBV) and negative (HTLV Tax) controls.

Figure 16:
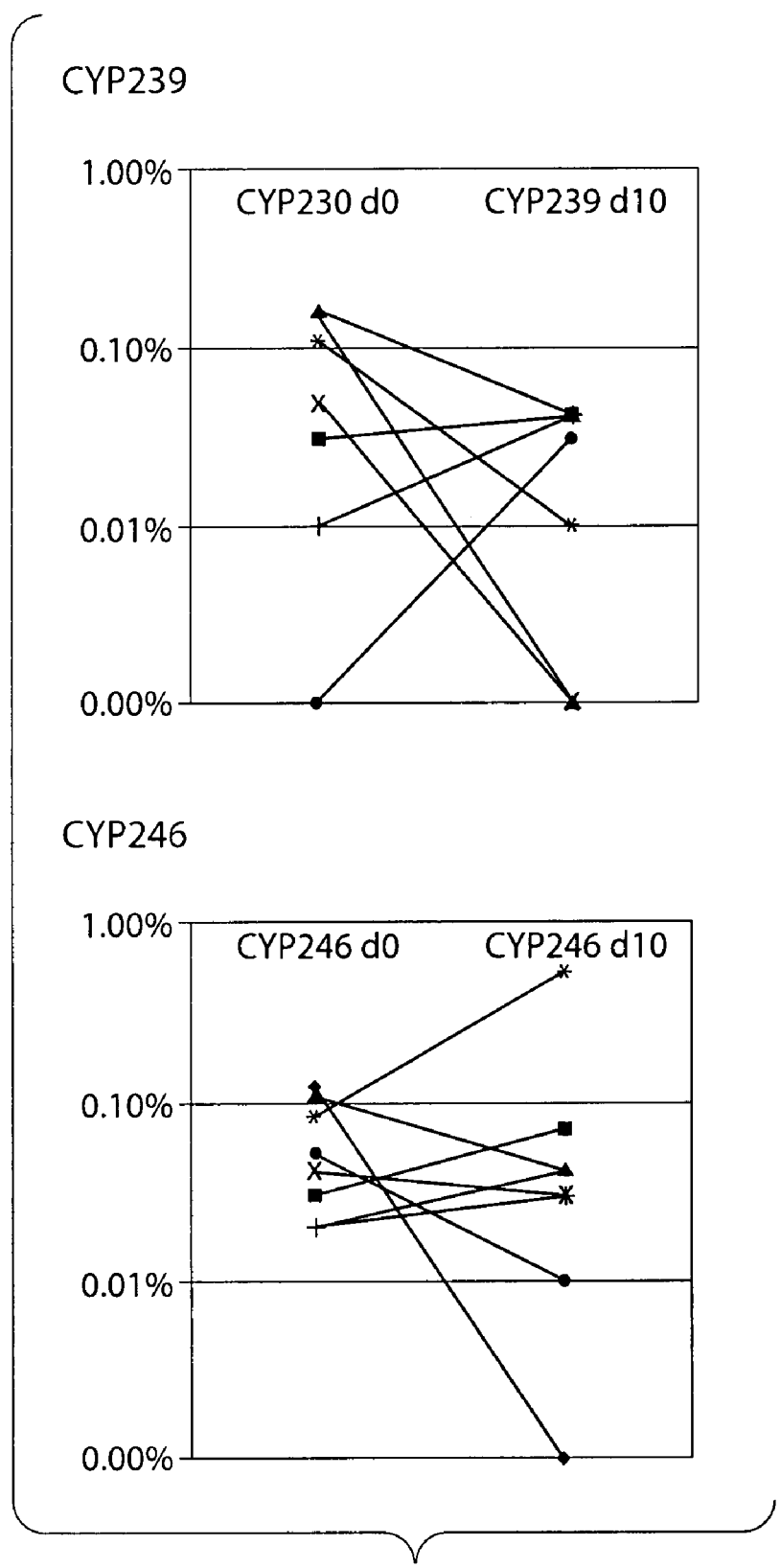
FIG. 16 is a set of graphs showing the detection of CYP1B1-specific CTL in normal HLA-A2+ donors.

As is shown in FIG. 16, T cells from HLA-A2+ healthy donors (n=8) were stained with CYP239 and CYP246 tetramers directly ex vivo and 10 days after in vitro restimulation with CYP239 or CYP246 peptides. The level of detection on day 10 is at 0.05% as determined from background staining of HLA-A2− donors. No expansion of CYP239-specific T cells was detected in healthy donors on day 10 (mean 0.022%±0.018%). CYP246-specific T cells were detected in 2 healthy donors with one rising to 0.5% (mean 0.032%±0.022%).

Figure 17:
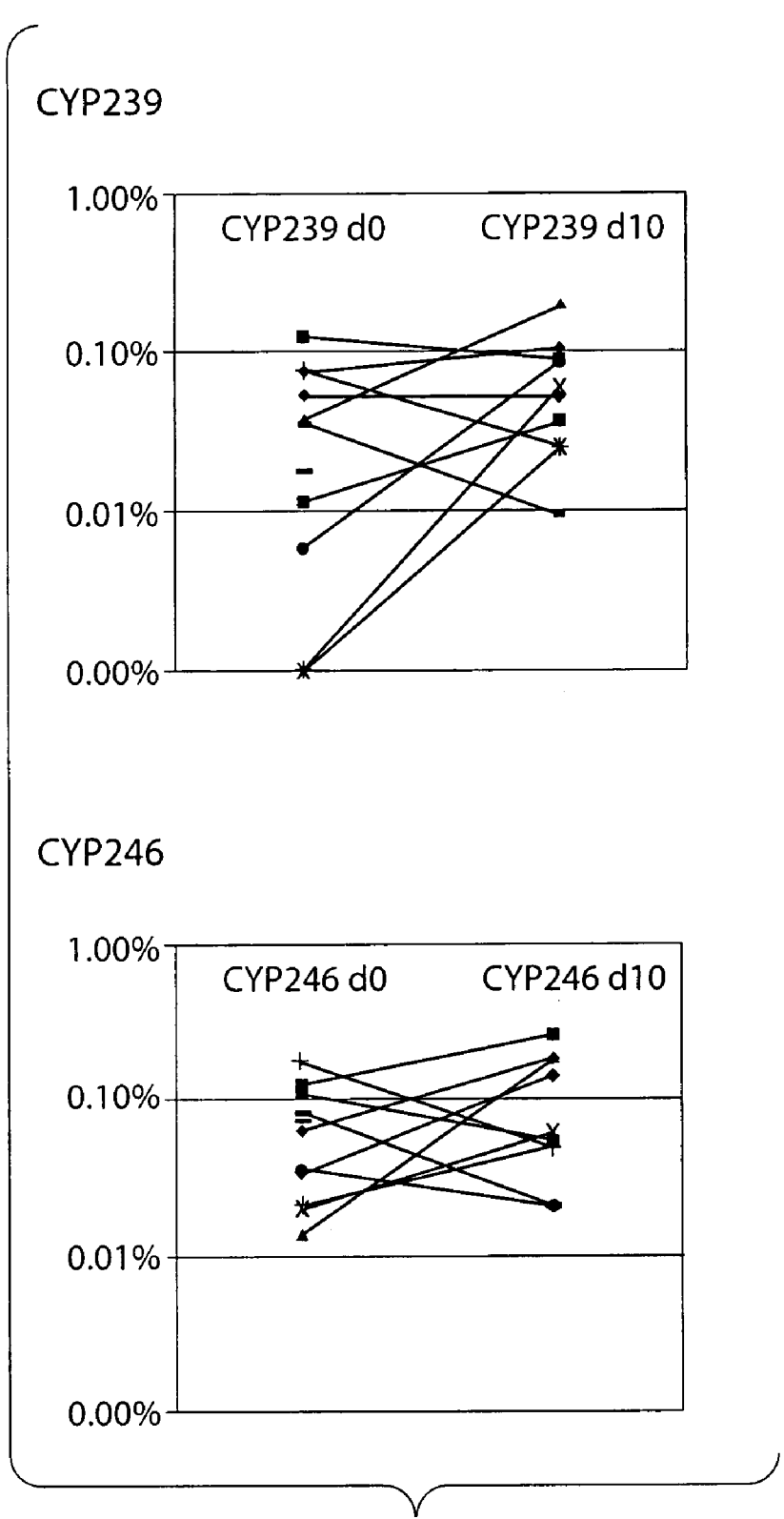
FIG. 17 is a set of graphs showing the detection of CYP1B1-specific CTL in HLA-A2+ multiple myeloma patients.

As is shown in FIG. 17, T cells from HLA-A2+ multiple myeloma patients (n=10) were stained with CYP239 and CYP246 tetramers directly ex vivo and 10 days after in vitro restimulation with CYP239 or CYP246 peptides. The level of detection on day 10 is at 0.05% as determined from background staining of HLA-A2-donors. 4 patients showed T cells reactive against CYP239>0.05% on day 10 (mean 0.068%±0.055%), whereas 5 patients showed reactivity against CYP246 (mean 0.098%±0.080%).

Table 10 shows the sequence of CYP1B1 and the sequences of CYP1B1 peptides that were identified by LPEP analysis as having binding affinity for HLA-A2.

TABLE 10

Identify HLA-A2 Binding Peptide Fragment. CYP1B1

Input Sequence:
MGTSLSPNDPWPLNPLSIQQTTLLLLLSVLATVHVGQRLLRQRRRQLRSAPPGPFAWPLIGNAAA
VGQAAHLSRARLARRYGDVFQIRLGSCPIVVLNGERAIHQALVQQGSAFADRPAFASFRVVSGGR
SMAFGHYSEHWKVQRRAAHSMMRNFFTRQPRSRQVLEGHVLSEARELVALLVRGSADGAFLDP
RPLTVVAVANVMSAVCFGCRYSHDDPEFRELLSHNEEFGRTVGAGSLVDVMPWLQYFPNPVRTV
FREFEQLNRNFSNFILDKFLRHCESLRPGAAPRDMMDAFILSAEKKAAGDSHGGGARLDLENVPA
TITDIFGASQDTLSTALQWLLLLFTRYPDVQTRVQAELDQVVGRDRLPCMGDQPNLPYVLAFLYE
AMRFSSFVPVTIPHATTANTSVLGYHIPKDTVVFVNQWSVNHDPLKWPNPENFDPARFLDKDGLI
NKDLTSRVMIFSVGKRRCIGEELSKMQLFLFISILAHQCDFRANPNEPAKMNFSYGLTIKPKSFKVN
VTLRESMELLDSAVQNLQAKETCQ (SEQ ID NO: 50)
Listed below are 9-residue peptides predicted to bind to the HLA-A2 allele with a ln(IC50) < 8. The first entry represents the location in the original sequence of the first amino acid of that peptide. Following the location is the peptide, for which the predicted ln (IC50) is given as the third entry.

| | | |
|---|---|---|
| 22 | TLLLLLSVL (SEQ ID NO: 51) | 7.08 |
| 23 | LLLLLSVLA (SEQ ID NO: 52) | 7.71 |
| 24 | LLLLSVLAT (SEQ ID NO: 53) | 6.05 |
| 25 | LLLSSVLATV (SEQ ID NO: 54) | 3.54 |
| 55 | FAWPLIGNA (SEQ ID NO: 55) | 5.11 |
| 88 | RLGSCPIVV (SEQ ID NO: 56) | 4.61 |
| 95 | VVLNGERAI (SEQ ID NO: 57) | 6.58 |
| 190 | FLDPRPLTV (SEQ ID NO: 58) | 6.52 |
| 200 | AVANVMSAV (SEQ ID NO: 59) | 6.14 |
| 239 | SLVDVMPWL (SEQ ID NO: 60) | 2.88 |
| 246 | WLQYFPNPV (SEQ ID NO: 61) | 6.23 |
| 292 | MMDAFILSA (SEQ ID NO: 62) | 3.31 |
| 312 | GARLDLENV (SEQ ID NO: 63) | 7.87 |
| 314 | RLDLENVPA (SEQ ID NO: 64) | 6.27 |
| 322 | ATITDIFGA (SEQ ID NO: 65) | 6.74 |
| 334 | TLSTALQWL (SEQ ID NO: 66) | 6.64 |
| 344 | LLFTRYPDV (SEQ ID NO: 67) | 4.69 |
| 377 | NLPYVLAFL (SEQ ID NO: 68) | 7.10 |
| 380 | YVLAFLYEA (SEQ ID NO: 69) | 1.56 |
| 381 | VLAFLYEAM (SEQ ID NO: 70) | 6.09 |
| 394 | FVPVTIPHA (SEQ ID NO: 71) | 7.03 |
| 419 | VVFVNQWSV (SEQ ID NO: 72) | 7.35 |
| 479 | QLFLFISIL (SEQ ID NO: 73) | 5.66 |
| 487 | LAHQCDFRA (SEQ ID NO: 74) | 7.54 |
| 510 | TIKPKSFKV (SEQ ID NO: 75) | 7.60 |
| 528 | LLDSAVQNI (SEQ ID NO: 76) | 4.08 |

Listed below are 10-residue peptides predicted to bind to the HLA-A2 allele with a ln(IC50) < 8

| | | |
|---|---|---|
| 4 | SLSPNDPWPL (SEQ ID NO: 77) | 5.26 |
| 20 | QTTLLLLLSV (SEQ ID NO: 78) | 6.75 |
| 21 | TTLLLLLSVL (SEQ ID NO: 79) | 7.01 |
| 22 | TLLLLLSVLA (SEQ ID NO: 80) | 5.18 |
| 23 | LLLLLLSVLAT (SEQ ID NO: 81) | 7.36 |
| 24 | LLLLSVLATV (SEQ ID NO: 82) | 4.55 |
| 26 | LLSVLATVHV (SEQ ID NO: 83) | 5.86 |
| 88 | RLGSCPIVVL (SEQ ID NO: 84) | 3.08 |
| 190 | FLDPRPLTVV (SEQ ID NO: 85) | 7.88 |
| 199 | VAVANVMSAV (SEQ ID NO: 86) | 7.87 |
| 234 | TVGAGSLVDV (SEQ ID NO: 87) | 7.73 |
| 255 | RTVFREFEQL (SEQ ID NO: 88) | 7.72 |
| 334 | TLSTALQWLL (SEQ ID NO: 89) | 5.85 |
| 336 | STALQWLLLL (SEQ ID NO: 90) | 5.96 |
| 343 | LLLFTRYPDV (SEQ ID NO: 91) | 5.60 |
| 380 | YVLAFLYEAM (SEQ ID NO: 92) | 5.54 |
| 388 | AMRFSSFVPV (SEQ ID NO: 93) | 7.39 |
| 418 | TVVFVNQWSV (SEQ ID NO: 94) | 6.72 |
| 477 | KMQLFLFISI (SEQ ID NO: 95) | 1.29 |
| 479 | QLFLFISILA (SEQ ID NO: 96) | 3.86 |
| 486 | ILAHQCDFRA (SEQ ID NO: 97) | 3.87 |
| 494 | RANPNEPAKM (SEQ ID NO: 98) | 7.06 |
| 502 | KMNFSYGLTI (SEQ ID NO: 99) | 7.12 |

The following Experimental Methods were used to obtain some of the Experimental Results set forth above.

Experimental Methods

Donor and Patient Samples

Peripheral blood from healthy blood donors and cancer patients (Table 2) was obtained by leukapheresis and peripheral blood mononuclear cells (PBMC) were purified by Ficoll-density centrifugation (Schultze et al., J. Clin. Invest. 100:2757-2765, 1997). Primary NHL and AML samples were obtained from discarded specimens. Leukapheresis products and tumor tissue were obtained following informal consent and approval by our institute's Review Board.

Cell Lines

The melanoma cell line K029 was a kind gift of Dr. G. Dranoff (Dana-Farber Cancer Institute, Boston). The fibroblast cell line GM847 was a kind gift of Dr. W. Hahn (Whitehead Institute of Biomedical Research, Cambridge). The 36M ovarian carcinoma cell line was a kind gift of Dr. S. Cannistra (Beth Israel Deaconess Hospital, Boston). The TAP-deficient T2 cell line; the multiple myeloma cell lines U266, IM9, and HS-Sultan; the melanoma cell line SK-MEL-2; and the ovarian carcinoma cell line SK-OV-3 were obtained from the American Type Culture Collection (ATCC; Manassas, Va.).

Peptides

The peptides CYP239 (SLVDVMPWL; SEQ ID NO: 1) and CYP246 (WLQYFPNPV; SEQ ID NO:2) from CYP1B1, the 1540 peptide from hTERT (ILAKFLHWL; SEQ ID NO: 100), the RT-pol476 (ILKEPVHGV; SEQ ID NO: 101) peptide from HIV, the HTLV-TAXI 1 (LLFGYPVYV; SEQ ID NO: 102), and the peptide F271 (FLWGPRALV; SEQ ID NO: 103) derived from MAGE-3 were purchased from Sigma Genosys Biotechnologies (The Woodlands, Tex.).

Peptide Prediction

Binding of peptides to HLA molecules can be predicted for the most common HLA alleles by computational methods (Parker et al., J. Immunol. 152:163-75, 1994; Gulukota et al., J. Mol. Biol. 267:1258-67, 1997). To increase specificity of peptide prediction we used two independent algorithms: a matrix algorithm available on the BIMAS (BioInformatics & Molecular Analysis Section at the NIH) web site (Parker et al., J. Immunol. 152:163-75, 1994) and a linear programming algorithm (LPpep) at Boston University (Z. Weng). BIMAS predicts for the half-life of peptides bound to class 1 molecules, while LPpep predicts an arbitrary half inhibitory concentration ($IC_{50}$) in competition with a labeled reference peptide. The output value is listed as $\ln(IC_{50})$.

HLA-A*0201 Binding Assay

TAP-deficient T2 cells were pulsed with 40 μg/ml of peptide and 3 μg/ml of β2-microglobulin (Sigma, St. Louis, Mo.) for 18 hours in serum-free IMDM (Life Technologies, Rockville, Md.) at 37° C. Cells were washed three times in serum-free IMDM and HLA-A*0201 expression was measured by flow cytometry using FITC-conjugated mAb BB7.2 (ATCC). Increase of HLA-A2 expression on T2 cells reflects stabilization of MHC complexes by the addition of exogenous peptides and was quantified using the fluorescence index (FI= ($MFI_{peptide\ pulsed\ T2}/MFI_{unpulsed\ T2})-1$).

Western Blot Analysis

CYP1B1 expression was determined in microsomal cell fractions. Microsomal protein was isolated by differential speed centrifugation. Cells were harvested, washed, and resuspended in hypotonic buffer. After mechanical homogenization high-density particles were pelleted by centrifugation for 20 minutes at 15,000 g. The supernatant was collected and centrifuged for 1 hour at 180,000 g. The pellet was resuspended in TEDG buffer, and 100 μg of microsomal protein was separated by SDS-PAGE and transferred to nitrocellulose membrane. Western blot for CYP1B1 was performed according to the manufacturer's recommendations (Gentest, Woburn, Mass.). Bands were visualized by enhanced chemiluminescent detection (NEN Life Science Products, Boston, Mass.).

Generation of CTL

CTL were generated as previously described (Vonderheide et al., Immunity 10:673-679, 1999), $CD8^+$ T cells (>80% $CD8^+$, >95% $CD3^+$, <2.0% $CD4^+$, and <5% $CD56^+$) were isolated from PBMC by negative selection using magnetic beads. B cells were activated via CD40, and DC were prepared from peripheral blood monocytes with IL-4 and GM-CSF (Schultze et al., J. Clin. Invest. 100:2757-2765, 1997). DC were harvested after 7 days, pulsed with peptide (40 μg/ml) and β2-microglobulin (3 μg/ml) for 2 hr at 37° C., irradiated (33 Gy), and added to autologous CD8+ T cells at a T:DC ratio of 20:1 in RPMI media supplemented with 10% human AB serum, 2 mM glutamine, 15 μg/ml gentamicin, 20 mMHEPES, and 15 ng/ml IL-7 (Endogen, Woburn, Mass.). At day 7 and weekly thereafter, T cell cultures were harvested and restimulated with irradiated (33 Gy), peptide-pulsed (10 μg/ml) autologous CD40-activated B cells. IL-2 (50 U/ml; Chiron Corp, Emeryville, Calif.) was introduced on day 8 and replenished as needed every 3-4 days. Flow cytometry was performed as described (Schultze et al., J. Clin. Invest. 100: 2757-2765, 1997). Assessment of cytotoxic effector function and tetramer analysis were performed with CTL cultures always >90% $CD3^+/CD8^+$, <5% $CD4^+$, and <5% $CD56^+$.

Cytotoxicity Assay

To assess cytolytic function CTL lines were used after at least four antigenic stimulations in standard $^{51}Cr$ release assays as previously described (Vonderheide et al., Immunity 10:673-679, 1999). Percent specific lysis was calculated from cpm of (experimental result−spontaneous release)/(maximum release−spontaneous release)×100%. Monocytes as targets were isolated from PBMC by RosetteSep® (Stem Cell Technologies, Vancouver) following the manufacturer's recommendations.

Tetramer Analysis

Tetrameric A2/peptide complexes with CYP239, CYP246, and TAX11, an immunogenic peptide derived from HTLV-1, were synthesized essentially as described (Altman et al., Science 274: 94-96, 1996) and conjugated to ALEXA-488 (Molecular Probes, Eugene, Oreg.). For staining of CTL lines, cells were incubated with the tetramer and CD8-PE (Beckman Coulter, Fullerton, Calif.) for 30 minutes at room temperature. Tetramers were also used to sort CYP239-specific CTL. Tetramer sorted CTL were expanded by mitogen stimulation as described (Valmori et al., Cancer Res. 59:2167-2173, 1999).

Use

Use of Universal Tumor Associated Antigens in Therapeutic Methods

As is discussed above, the invention provides methods for preventing or treating conditions associated with excessive cell proliferation and expression of CYP1B1, such as cancer.

Examples of conditions that can be prevented or treated using the methods of the invention, include, for example, all cancers, e.g., melanoma, lymphoma, carcinoma, sarcoma, multiple myeloma, leukemia, lung cancer, ovarian cancer, uterine cancer, cervical cancer, prostate cancer, liver cancer, colon cancer, pancreatic cancer, and brain cancer. Pre-cancerous and non-cancerous conditions characterized by excessive cell proliferation, and expression of a CYP1B1, can be treated using the methods of the invention as well. For example, all carcinomas in situ, e.g., ductal carcinoma in situ, lobular carcinoma in situ, and cervical carcinoma in situ, as well as adenoma and benign polyps can be treated using the methods of the invention.

Patients that can be treated using the methods of the invention include those whose conditions are at early, intermediate, or advanced stages of development. Patients can receive treatment according to the invention before, during, or after other types of treatment, such as chemotherapy, radiation, or surgery, or can receive the treatment of the invention in the absence of any other type of treatment. The methods of the invention can also be used as general prophylactic measures; to prevent conditions from arising in patients that are at risk, or have early signs, of developing a condition associated with excessive cellular proliferation, such as cancer; or to prevent recurrence of such a condition. Additional persons that can be treated, in particular, using vaccination methods of the invention (see below), are those who are to donate cells, such as cytotoxic T lymphocytes, for use in the treatment of another (see below).

Central to the prophylactic and therapeutic methods of the invention is the pathway of cell-mediated immunity involving cytotoxic T lymphocytes (CTLs). In this pathway, an antigen is taken up and processed by an antigen presenting cell, so that a peptide of the antigen is presented on the surface of the cell, in the context of MHC. Such antigen presenting cells then activate cytotoxic T lymphocytes, in an MHC-restricted fashion, to proliferate and kill target cells that express the antigen.

The prophylactic and therapeutic methods of the invention intervene in this pathway at different levels. For example, in one of these methods, a CYP1B1 antigen is administered to a patient, in whom the antigen is taken up by antigen presenting cells, which in turn activate CTLs. In another of these methods, an antigen presenting cell is contacted with a CYP1B1 antigen ex vivo, where it takes up, processes, and presents the antigen, in the context of MHC. Such ex vivo stimulated APCs are then administered to a patient, in whom they specifically activate CTLs. In yet another of these methods, CTLs are activated ex vivo with APCs presenting CYP1B1 peptides, and the activated CTLs are then administered to a patient. These methods, each of which includes numerous variations, are described in further detail below. Also, it is noted that all of these methods can be carried out with CYP1B1 peptides alone or, preferably, in combination with another (or more) tumor associated antigen polypeptides or peptides (e.g., telomerase).

As is noted above, the prophylactic and therapeutic methods of the invention include one in which CYP1B1, or a fragment thereof that binds to MHC, is administered to a patient, in whom the antigen or fragment is taken up by and processed within an antigen presenting cell, which in turn activates a cytotoxic T cell in the patient. This vaccination method can be carried out using CYP1B1, one or more MHC-binding peptides of CYP1B1, and, in addition to these (or a combination thereof), one or more universal TAAs or one or more MHC-binding peptides of more than one universal TAA, or a combination thereof. Optionally, the antigen can be administered in combination with an adjuvant to enhance the anti-TAA immune response, or the antigen can be packaged into a delivery system (see below).

Any reagent including CYP1B1 or a MHC-binding peptide thereof can be used for vaccination. These include, without limitation, full length CYP1B1, MHC-binding fragments of CYP1B1, as well as fusion proteins including CYP1B1 and MHC-binding fragments thereof. Peptides or polypeptides including CYP1B1 peptides and polypeptides can include 8, 9, 10, 11, 12, or more amino acid stretches having sequence identity with a region of CYP1B1. For example, the peptides can include nine amino acid stretches, in which seven, eight, or all nine of the amino acids in the CYP1B1 peptide nine amino acid sequence are identical to a region of nine amino acids in CYP1B1. In addition, a CYP1B1 peptide or polypeptide can include up to 533 amino acids that are identical to an amino acid sequence found in CYP1B1, for example, 9-20, 20-40, 40-80, 80-200, or 200-533 amino acids that are identical to an amino acid sequence found in CYP1B1. Polypeptides containing CYP1B1 peptides can contain additional amino acid stretches that do not correspond to the amino acid sequence of CYP1B1.

To vaccinate a patient to elicit a CYP1B1-specific immune response in the patient, it is necessary to obtain large amounts of a CYP1B1 protein or peptide, and this can be accomplished by numerous standard methods, for example, chemical synthesis (e.g., Fmoc methods (Sigma Genosys); see above) or expression in eukaryotic or prokaryotic cells.

Recombinant CYP1B1 peptides can be overexpressed in vivo by introducing coding sequences of the peptides into various types of cells, or in vitro, using cell-free expression systems that are known in the art. The peptide products can then be purified for generating CYP1B1-specific CTLs ex vivo and for vaccine production. Purified CYP1B1 peptides are also useful for diagnostic assays that measure the presence of CYP1B1-specific CTLs in a test sample. For example, the presence (or increased levels) of CYP1B 1-specific CTLs in a sample from a subject who has received an anti-CYP1B1 vaccination, relative to the level of CYP1B 1-specific CTLs in a reference sample (such as a pre-vaccination sample from the patient), indicates that the patient has mounted a CYP1B1-specific immune response.

CYP1B1 peptides can be produced by chemical synthesis (e.g., by the methods described in *Solid Phase Peptide Synthesis,* 2nd ed., 1984, The Pierce Chemical Co., Rockford, Ill., or by other methods known to those skilled in the art of peptide synthesis).

A wide variety of expression systems can be used to produce recombinant CYP1B1 peptides, polypeptides, fragments, fusion proteins, and amino acid sequence variants. CYP1B1 peptides can be produced in prokaryotic hosts (e.g., *E. coli*) or in eukaryotic hosts (e.g., *S. cerevisiae*, insect cells, such as Sf9 cells, or mammalian cells, such as COS-1, NIH 3T3, or HeLa cells). These cells are commercially available from, for example, the American Type Culture Collection, Rockville, Md. (also see, e.g., Ausubel et al., *Current Protocols in Molecular Biology*, John Wiley & Sons, New York, N.Y., 1998). The method of transformation and the choice of expression vehicle (e.g., expression vector) depends on the host system selected. Transformation and transfection methods are described, e.g., by Ausubel et al., supra, and expression vehicles can be chosen from the numerous examples that are known in this field.

First, a nucleic acid molecule encoding a CYP1B1 peptide is introduced into a plasmid or other vector, which is then used to transform living cells. Constructs in which a cDNA containing the entire CYP1B1 coding sequence, a fragment of the CYP1B1 coding sequence, amino acid variations of the CYP1B1 coding sequence, or fusion proteins of the aforementioned, inserted in the correct orientation into an expression plasmid, can be used for protein expression. Prokaryotic and eukaryotic expression systems allow various immunogenic domains of CYP1B1 peptides or polypeptides to be recovered as fusion proteins, and then used for the generation of CYP1B1-specific CTLs. In some cases, for example, when a CYP1B1 peptide is to be expressed directly within a patient's cells, it may be desirable to express the CYP1B1 peptide under the control of an inducible or tissue-specific promoter.

Typical expression vectors contain promoters that direct the synthesis of large amounts of mRNA corresponding to the inserted CYP1B1 peptide-encoding nucleic acid molecule in the plasmid-bearing cells. They can also include eukaryotic or prokaryotic "origin of replication" sequences, which allow for their autonomous replication within the host organism, sequences that encode genetic traits that allow vector-containing cells to be selected in the presence of otherwise toxic drugs (such as antibiotics), and sequences that increase the efficiency with which the synthesized mRNA is translated. Stable, long-term vectors can be maintained as freely replicating entities within cells by using regulatory elements of, for example, viruses (e.g., the OriP sequences from the Epstein Barr Virus genome). Cell lines can also be produced that have the vector integrated into genomic DNA, and, in this manner, the gene product is produced on a continuous basis.

Expression of foreign sequences in bacteria such as *Escherichia coli* requires insertion of a nucleic acid molecule encoding a polypeptide into a bacterial expression vector. Plasmid vectors in this category contain several elements required for propagation of the plasmid in bacteria and expression of inserted DNA of the plasmid by the plasmid-carrying bacteria. Propagation of only plasmid-bearing bacteria is achieved by introducing into the plasmid selectable marker-encoding sequences that allow plasmid-bearing bacteria to grow in the presence of otherwise toxic drugs (e.g., antibiotics). The plasmid also includes a transcriptional promoter that capable of producing large amounts of mRNA from the cloned gene. Such promoters may or may not be inducible promoters. The plasmid also, preferably, contains a polylinker to simplify insertion of the gene in the correct orientation within the vector. For example, in a simple *E. coli* expression vector utilizing the lac promoter, the expression vector plasmid contains a fragment of the *E. coli* chromosome containing the lac promoter and the neighboring lacZ gene. In the presence of the lactose analog IPTG, RNA polymerase normally transcribes the lacZ gene, producing lacZ mRNA, which is translated into the encoded protein, β-galactosidase. The lacZ gene can be cut out of the expression vector with restriction endonucleases and replaced by a CYP1B1 peptide gene sequence, or a fragment, fusion, or mutant thereof. When the resulting plasmid is transfected into *E. coli*, addition of IPTG and subsequent transcription from the lac promoter produces mRNA encoding the CYP1B1 polypeptide of interest, which is then translated into a polypeptide.

Once the appropriate expression vector containing a CYP1B1 gene is constructed, it is introduced into an appropriate host cell by transformation, transfection, or transduction techniques that are known in the art, including calcium chloride transformation, calcium phosphate transfection, DEAE-dextran transfection, electroporation, microinjection, protoplast fusion, and liposome-mediated transfection. The host cells that are transformed with the vectors of this invention can include (but are not limited to) *E. coli* or other bacteria, yeast, fungi, insect cells (using, for example, baculoviral vectors for expression), human, mouse, or other animal cells. Mammalian cells can also be used to express CYP1B1 peptides using a vaccinia virus expression system, as is described by Ausubel et al., supra.

In vitro expression of CYP1B1 peptides, proteins, fusions, polypeptide fragments, or mutated versions thereof encoded by cloned DNA is also possible using the T7 late promoter expression system. Plasmid vectors containing late promoters and the corresponding RNA polymerases from related bacteriophages such as T3, T5, and SP6 can also be used for in vitro production of proteins from cloned DNA. *E. coli* can also be used for expression using an M 13 phage such as mGPI-2. Furthermore, vectors that contain phage lambda regulatory sequences, or vectors that direct the expression of fusion proteins, for example, a maltose-binding protein fusion protein or a glutathione-S-transferase fusion protein, also can be used for expression in *E. coli*.

Eukaryotic expression systems permit appropriate post-translational modifications to expressed proteins. Transient transfection of a eukaryotic expression plasmid allows the transient production of CYP1B1 peptides by a transfected host cell. CYP1B1 peptides can also be produced by a stably-transfected mammalian cell line. A number of vectors suitable for stable transfection of mammalian cells are available to the public (e.g., see Pouwels et al., *Cloning Vectors: A Laboratory Manual*, 1985, Supp. 1987), as are methods for constructing such cell lines (see, e.g., Ausubel et al., supra). In one example, cDNA encoding a CYP1B1 peptide, protein, fragment, mutant, or fusion protein is cloned into an expression vector that includes the dihydrofolate reductase (DHFR) gene. Integration of the plasmid and, therefore, integration of the CYP1B1 peptide-encoding gene into the host cell chromosome is selected by inclusion of 0.01-300 μM methotrexate in the cell culture medium (as is described by Ausubel et al., supra). This dominant selection can be accomplished in most cell types. Recombinant protein expression can be increased by DHFR-mediated amplification of the transfected gene. Methods for selecting cell lines bearing gene amplifications are described by Ausubel et al., supra. These methods generally involve extended culture in medium containing gradually increasing levels of methotrexate. The most commonly used DHFR-containing expression vectors are pCVSEII-DHFR and pAdD26SV(A) (described by Ausubel et al., supra). The host cells described above or, preferably, a DHFR-deficient CHO cell line (e.g., CHO DHFR-cells, ATCC Accession No. CRL 9096) are among those most preferred for DHFR selection of a stably-transfected cell line or DHFR-mediated gene amplification. Other drug markers can be analogously used.

Expression of proteins, such as those containing CYP1B1 peptides, in eukaryotic cells allows the production of large amounts of normal or mutant proteins for isolation and purification, and the use of cells expressing a CYP1B1 peptide-containing protein provides a functional assay system for antibodies generated against a CYP1B1 peptide of interest.

Another preferred eukaryotic expression system is the baculovirus system using, for example, the vector pBac-PAK9, which is available from Clontech (Palo Alto, Calif.). If desired, this system can be used in conjunction with other protein expression techniques, for example, the myc tag approach described by Evan et al. (*Mol. Cell. Biol.* 5:3610-3616, 1985).

Once a recombinant CYP1B1 protein is expressed, it can be isolated from the expressing cells by cell lysis followed by protein purification techniques, such as affinity chromatography. In this example, an anti-CYP1B1 peptide antibody, which can be produced by methods that are well-known in the art, can be attached to a column and used to isolate recombinant CYP1B1 peptide-containing proteins. Lysis and fractionation of CYP1B1 peptide-harboring cells prior to affinity chromatography can be performed by standard methods (see, e.g., Ausubel et al., supra). Once isolated, the recombinant protein can, if desired, be purified further, e.g., by high performance liquid chromatography (HPLC; e.g., see Fisher, *Laboratory Techniques in Biochemistry and Molecular Biology*, Work and Burdon, Eds., Elsevier, 1980).

Preferably, CYP1B1 or a MHC-binding peptide thereof is administered to a patient in association with an adjuvant. For example, a chemical antigen (e.g., Freund's incomplete adjuvant; cytoxan; an aluminum compound, such as aluminum hydroxide, aluminum phosphate, or aluminum hydroxyphosphate; liposomes; ISCOMS; microspheres; protein chochleates; vesicles consisting of nonionic surfactants; cationic amphiphilic dispersions in water; oil/water emulsions; muramidyldipeptide (MDP) and its derivatives such as glucosyl muramidyldipeptide (GMDP), threonyl-MDP, murametide and murapalmitin; and QuilA and its subfractions; as well as various other compounds such as monophosphoryl-lipid A (MPLA); gamma-inulin; calcitriol; and loxoribine) can be used.

A biological response modifier, which is a soluble mediator that affects induction of an immune response, can also be used as an adjuvant. For example, cytokines (e.g., IL-2 and GM-CSF), chemokines, co-stimulatory molecules (e.g., B7, ICAM, class I monoclonal antibodies, stem cell factor, and stimulated T cells) can be used. Also, bacterial products, such as toxins or, preferably, subunits or fragments thereof that have reduced (if any) toxicity, but maintained adjuvant activity.

Additional types of adjuvant molecules that can be used in the invention include, for example, biological modifiers of the death response (e.g., apoptosis sensitizers) and compounds or treatment that increases the susceptibility of the target cell to treatment, such as radiation and chemotherapy. Also, increasing expression of CYP1B1 in the cell can increase susceptibility of the cell to treatment according to the invention.

Finally, as is described above, cellular adjuvants can be used in the immunization methods of the invention. For example, a CYP1B1 peptide can be administered to a patient on the surface of an antigen presenting cell, in the context of MHC. In additional to professional antigen presenting cells, e.g., dendritic cells, CD40-activated B cells, irradiated tumor cells (e.g., in association with GM-CSF), alternative antigen presenting cells, synthetic antigen presenting cells (e.g., lipid mycels and artificial APC-like scaffolds), and fusions of any of the above-listed cells can be used.

As an alternative to vaccination with a CYP1B1 protein or peptide, vaccination with a nucleic acid molecule that encodes such a protein or peptide can be used for vaccination. Such nucleic acid molecules can be administered as "naked" DNA molecules, present in a plasmid or viral vector, or packaged into a liposome or cell, such as eukaryotic cell, prior to administration. The nucleic acid molecules can be administered to a patient in vivo, or can be used to treat a cell ex vivo (e.g., an antigen presenting cell, such as a dendritic cell or a CD40-activated B cell), which is then administered to the patient. Alternatively, RNA, e.g., mRNA, can be used in these methods (see, e.g., Boczkowski et al., J. Exp. Med. 184:465-472, 1996; J. Exp. Med. 186:1177-1182, 1997).

For in vivo expression, a gene that encodes a polypeptide that includes CYP1B1 or an MHC-binding peptide thereof must be delivered to cells in a form that can be taken up by the cells, in which a sufficient level of protein is expressed to induce an effective immune response. Retroviral, adenoviral, lentiviral, poxyiral, and other viral vectors are suited as nucleic acid expression vectors for in vivo delivery, because they show efficient infection and/or integration and expression; see, e.g., Cayouette et al., Hum. Gene Therapy, 8:423-430, 1997; Kido et al., Curr. Eye Res. 15:833-844, 1996; Bloomer et al., J. Virol. 71:6641-6649, 1997; Naldini et al., Science 272:263-267, 1996; Miyoshi et al., Proc. Nat. Acad. Sci., U.S.A., 94:10319-1032, 1997; *Vaccines: New Approaches to Immunological Problems*, R. W. Ellis (Ed.), Butterworth-Heinemann, Boston. For example, any DNA fragment that encodes a polypeptide that contains a CYP1B1 peptide can be cloned into a retroviral vector and transcribed via its endogenous promoter, via an exogenous promoter, via a promoter specific for the target cell type of interest, or, in the case of retroviral vectors, via the retroviral long terminal repeat. Other viral vectors that can be used include adenovirus, adeno-associated virus, poxviruses, such as vaccinia virus or bovine papilloma virus, or a herpes virus, such as Epstein-Barr Virus.

Gene transfer in vivo can also be achieved by non-viral means. For example, a plasmid vector that encodes a polypeptide that contains a CYP1B1 peptide can be injected directly into skeletal muscle or cardiac muscle by previously described methods (e.g., Wolff et al., Science, 247:1465-1468, 1990). Expression vectors injected into skeletal muscle in situ are taken up into muscle cell nuclei and used as templates for expression of their encoded proteins. CYP1B1 peptide-encoding genes that are engineered to contain a signal peptide are secreted from CYP1B1 peptide-expressing muscle cells, after which they induce an immune response. Gene transfer into cells within the tissues of a living animal also can be achieved by lipofection (Felgner et al., Proc. Natl. Acad. Sci. USA 84:7413, 1987; Ono et al., Neurosci. Lett. 117:259, 1990; Brigham et al., Am. J. Med. Sci. 298:278, 1989; Staubinger et al., Meth. Enz. 101:512, 1983), or asialoorosomucoid-polylysine conjugation (Wu et al., J. Biol. Chem. 263:14621, 1988; Wu et al., J. Biol. Chem. 264:16985, 1989), and analogous methods.

Retroviral vectors, adenoviral vectors, adenovirus-associated viral vectors, or other viral vectors also can be used to deliver genes encoding CYP1 B1 peptides or polypeptides to cells ex vivo. Numerous vectors useful for this purpose are generally known (see, e.g., Miller, Human Gene Therapy 15-14, 1990; Friedman, Science 244:1275-1281, 1989; Eglitis et al., BioTechniques 6:608-614, 1988; Tolstoshev et al., Curr. Opin. Biotech. 1:55-61, 1990; Sharp, The Lancet 337: 1277-1278, 1991; Cometta et al., Nucl. Acid Res. and Mol. Biol. 36:311-322, 1987; Anderson, Science 226: 401-409, 1984; Moen, Blood Cells 17:407-416, 1991; Miller et al., Biotech. 7:980-990, 1989; Le Gal La Salle et al., Science 259:988-990, 1993; and Johnson, Chest 107:77 S-83S, 1995). Retroviral vectors are particularly well developed and have been used in clinical settings (Rosenberg et al., N. Engl. J. Med 323:370, 1990; Anderson et al., U.S. Pat. No. 5,399,346).

Gene transfer into cells ex vivo can also be achieved by delivery of non-viral vectors, such as expression plasmids, using methods such as calcium phosphate or DEAE dextran transfection, electroporation, and protoplast fusion. Liposomes can also be potentially beneficial for delivery of DNA into a cell.

Cells that are to be transduced or transfected ex vivo can be obtained from a patient (e.g., peripheral blood cells, such as B cells or dendritic cells, bone marrow stem cells, or cells from a tumor biopsy) prior to transfection, and re-introduced after transfection. However, the cells also can be derived from a source other than the patient undergoing gene transfer.

In the constructs described above, CYP1B1 peptide expression can be directed from any suitable promoter (e.g., the human cytomegalovirus (CMV), simian virus 40 (SV40), or metallothionein promoters), and regulated by any appropriate mammalian regulatory element. For example, if desired, enhancers known to preferentially direct gene expression in skeletal muscle cells can be used to direct CYP1B1 peptide expression for vaccination in situ. The enhancers used can include, without limitation, those that are characterized as tissue- or cell-specific in their expression.

Conventional pharmaceutical practice can be employed to provide suitable formulations or compositions to administer CYP1B1 peptide or nucleic acid vaccinations for treatment of, or prophylaxis against, cancer. CYP1B1 peptides, CYP1B1 polypeptides, and CYP1B1 nucleic acid molecules can be administered within a pharmaceutically-acceptable diluent, carrier, or excipient, in unit dosage form. Administration can begin before a patient is symptomatic. Any appropriate route of administration can be employed, for example, administration can be parenteral, intravenous, intra-arterial, subcutaneous, intramuscular, intracranial, intraorbital, ophthalmic, intraventricular, intracapsular, intraspinal, intracisternal, intraperitoneal, intranasal, aerosol, by suppositories, or oral administration. Therapeutic formulations can be in the form of liquid solutions or suspensions; for oral administration, formulations can be in the form of tablets or capsules; and for intranasal formulations, in the form of powders, nasal drops, or aerosols. An adjuvant, e.g., as listed above, can be included with the formulation.

Methods well known in the art for making formulations are found, for example, in *Remington's Pharmaceutical Sciences*, (18$^{th}$ edition), ed. A. Gennaro, 1990, Mack Publishing Company, Easton, Pa. Formulations for parenteral administration can, for example, contain excipients, sterile water, or saline, polyalkylene glycols such as polyethylene glycol, oils of vegetable origin, or hydrogenated napthalenes. Biocompatible, biodegradable lactide polymer, lactide/glycolide copolymer, or polyoxyethylene-polyoxypropylene copolymers can be used to control the release of the compounds. Other potentially useful parenteral delivery systems for CYP1B1 peptides, polypeptides, and CYP1B1 nucleic acid molecules include ethylene-vinyl acetate copolymer particles, osmotic pumps, implantable infusion systems, and liposomes. Formulations for inhalation can contain excipients, for example, lactose, or can be aqueous solutions containing, for example, polyoxyethylene-9-lauryl ether, glycocholate and deoxycholate, or can be oily solutions for administration in the form of nasal drops, or as a gel.

As is mentioned above, in addition to the vaccination methods described above, which result in the activation of antigen-specific, MHC-restricted CTLs in vivo, such cells (i.e., antigen-specific, MHC-restricted CTLs) can be generated in vitro, and then administered to patients. Any cell that expresses an endogenous or exogenously-introduced major histocompatibility antigen-encoding gene can be used to present a CYP1B1 peptide to generate CYP1B1-specific CTLs in vitro. In one variation of this approach, a peptide-presenting cell expresses an endogenously or exogenously-introduced CYP1B1 polypeptide-encoding gene. Expression of endogenous CYP1B1 in antigen-presenting cells can be stimulated as described in Schultze et al., supra, by cytokines, such as IL-2, or by other molecules that are known to those of skill in this art to stimulate CYP1B1 expression.

In another variation, the antigen presenting cells are pulsed with CYP1B1 or MHC-binding peptide thereof, and the pulsed cells are then used to generate CTLs for administration to a patient. Preferably, the CTLs used in these methods are obtained from the patient to whom they are to ultimately be administered (i.e., the cells are autologous). Alternatively, donor cells (i.e., allogeneic cells) can be used in this method.

Finally, methods in which any of the above-described immunotherapeutic approaches are combined are included in the invention. For example, a patient may be treated with an ex vivo, CYP1B1-activated CTL and/or an ex vivo, CYP1B1-pulsed APC (e.g., a DC or a CD40-activated B cell), and this treatment can be carried out before, during, or after a vaccination approach (see above). In addition to combining the approaches, each approach (or a combination thereof) can employ multiple peptides of CYP1B1, peptides of other TAAs, or a combination thereof.

Measurement of CYP1B1-Specific CTL Levels in Patients, CTL Donors, and CYP1B1-Specific CTL Preparations Generated Ex Vivo Patients who have one or more tumors containing CYP1B1-expressing tumor cells and patients who are at risk for developing such tumors can be vaccinated with compositions containing one or more CYP1B1 peptides, CYP1B1 polypeptides, CYP1B1 nucleic acid molecules, cells presenting a CYP1B1 peptide, or mixtures thereof (other TAA (e.g., hTERT) polypeptides, peptides, nucleic acid molecules, or APCs can also be included). Subjects to be used as donors of CYP1B1-specific CTLs for transfer into patients can be similarly vaccinated. Levels of CYP1B1-specific CTLs that result from CYP1B1-specific vaccination of patients or other subjects, or ex vivo generation of CYP 1B1 specific CTLs, can be monitored using well-known methods. An increase in the level of CYP1B1-specific CTLs in a test sample from a vaccinated subject or a CTL culture stimulated with CYP1B1 ex vivo, relative to a reference sample (e.g., a pre-vaccination or pre-stimulation sample), indicates that a CYP1B1-specific CTL response has been stimulated in a vaccinated subject or CYP1B1-stimulated CTL culture. Preferably the increase is by at least 50%, more preferably, at least 100%, still more preferably, at least 200%, and most preferably, at least 400%. In addition, the efficacy of non-antigen-specific immunotherapies (e.g., administration of IL-2 or interferon) against tumors containing CYP1B1-expressing cells can be monitored using similar approaches.

Levels of CYP1B1-specific CTLs can also be assessed in naive subjects who have not received CYP1B1 vaccinations or other treatment for the purpose of generating CYP1B1-specific CTLs. Since some types of tumors (e.g., malignant melanoma, renal cell carcinoma, and non-Hodgkin's lymphoma) themselves elicit immune responses in their hosts, an increase in the level of CYP1B1-specific CTLs cells in a patient sample, compared to the level in a reference sample from a normal subject who does not have a tumor, or in a reference sample that was previously obtained from the patient, can indicate the development of a tumor in a patient not known to have a tumor or an increase in tumor burden (e.g., increased tumor size, or the development or increase in metastatic tumors) in a patient known to have a tumor.

One approach by which the level of CYP1B1-specific CTLs can be measured is using standard cytotoxicity assays, such as the Cr$^{51}$ release assay (Schultze et al., J. Clin. Invest. 100:2757, 1997), which is described above. Another approach for measuring the level of CYP1B1-specific CTLs involves measuring the binding of peptide-specific CTLs to a tetrameric peptide/MHC complex in vitro, as is described by Altman et al. (Science 274:94-96, 1996). Briefly, a fusion protein containing an HLA heavy chain molecule, such as HLA-A*0201, plus a peptide that is a substrate for biotinylation at the C-terminus of the HLA polypeptide, is produced. The fusion protein is folded in vitro in the presence 2-microglobulin and a CYP1B1 peptide ligand. The purified MHC/CYP1B1 peptide complexes are then biotinylated at the C-terminus of the HLA heavy chain, and tetramers are produced by mixing the biotinylated MHC/CYP1B1 peptide complexes with phycoerythrin-labeled deglycosylated avidin at a molar ratio of 4:1. Samples that contain CTLs (such as blood samples or ex vivo cultures) are mixed with the CYP1B1 peptide/MHC tetrameric complexes and the relative amount of CYP1B1-specific CTLs that bind to the CYP1B1 peptide/MHC tetrameric complexes can be measured for each sample by flow cytometry, using methods described by Altman et al., supra, and by other methods known to those of skill in this art. Another method that can be used is ELISPOT (Herr et al., J. Immunol. Methods 203:141-152, 1997).

OTHER EMBODIMENTS

All publications and patent applications mentioned in this specification are herein incorporated by reference to the same extent as if each independent publication or patent application was specifically and individually indicated to be incorporated by reference.

While the invention has been described in connection with specific embodiments thereof, it will be understood that it is capable of further modifications, and this application is intended to cover any variations, uses, or adaptations of the invention following, in general, the principles of the invention and including such departures from the present disclosure come within known or customary practice within the art to which the invention pertains and can be applied to the essential features hereinbefore set forth, and follows in the scope of the appended claims.

| | | |
|---|---|---|
| 25 | LLLSVLATV | (SEQ ID NO: 220) |
| 22 | TLLLLLSVL | (SEQ ID NO: 221) |
| 528 | LLDSAVQNL | (SEQ ID NO: 222) |
| 479 | QLFLFISIL | (SEQ ID NO: 223) |
| 190 | FLDPRPLTV | (SEQ ID NO: 224) |
| 377 | NLPYVLAFL | (SEQ ID NO: 225) |
| 344 | LLFTRYPDV | (SEQ ID NO: 226) |
| 334 | TLSTALQWL | (SEQ ID NO: 227) |
| 239 | SLVDVMPWL | (SEQ ID NO: 228) |
| 58 | PLIGNAAAV | (SEQ ID NO: 229) |
| 24 | LLLLSVLAT | (SEQ ID NO: 230) |
| 21 | TTLLLLLSV | (SEQ ID NO: 231) |
| 170 | VLSEARELV | (SEQ ID NO: 232) |
| 17 | SIQQTTLLL | (SEQ ID NO: 233) |
| 521 | TLRESMELL | (SEQ ID NO: 234) |
| 510 | TIKPKSFKV | (SEQ ID NO: 235) |
| 196 | LTVVAVANV | (SEQ ID NO: 236) |
| 76 | RLARRYGDV | (SEQ ID NO: 237) |
| 372 | MGDQPNLPY | (SEQ ID NO: 238) |
| 241 | VDVMPWCQY | (SEQ ID NO: 239) |
| 404 | TANTSVLGY | (SEQ ID NO: 240) |

-continued

| | | |
|---|---|---|
| 190 | FLDPRPLTV | (SEQ ID NO: 241) |
| 185 | SADGAFLDP | (SEQ ID NO: 242) |
| 174 | ARELVALLV | (SEQ ID NO: 243) |
| 171 | LSEARELVA | (SEQ ID NO: 244) |
| 165 | VLEGHVLSE | (SEQ ID NO: 245) |
| 7 | PNDPWPLNP | (SEQ ID NO: 246) |
| 445 | FLDKDGLIN | (SEQ ID NO: 247) |
| 341 | WLLLLFTRY | (SEQ ID NO: 248) |
| 522 | LRESMELLD | (SEQ ID NO: 249) |
| 336 | STALQWLLL | (SEQ ID NO: 250) |
| 218 | DPEFRELLS | (SEQ ID NO: 251) |
| 206 | SAVCFGCRY | (SEQ ID NO: 252) |
| 129 | GRSMAFGHY | (SEQ ID NO: 253) |
| 439 | NFDPARFLQ | (SEQ ID NO: 254) |
| 378 | LPYVLAFLY | (SEQ ID NO: 255) |
| 192 | DPRPLTVVA | (SEQ ID NO: 256) |
| 51 | PPGPFAWPL | (SEQ ID NO: 257) |
| 414 | IPKDTVVFV | (SEQ ID NO: 258) |
| 375 | QPNLPYVLA | (SEQ ID NO: 259) |
| 288 | APRDMMDAF | (SEQ ID NO: 260) |
| 399 | IPHATTANT | (SEQ ID NO: 261) |
| 250 | FPNPVRTVF | (SEQ ID NO: 262) |
| 194 | RPLTVVAVA | (SEQ ID NO: 263) |
| 512 | KPKSFKVNV | (SEQ ID NO: 264) |
| 50 | APPGPFAWP | (SEQ ID NO: 265) |
| 320 | VPATITDIF | (SEQ ID NO: 266) |
| 117 | RPAFASFRV | (SEQ ID NO: 267) |
| 89 | LGSCPIVVL | (SEQ ID NO: 268) |
| 57 | WPLIGNAAA | (SEQ ID NO: 269) |
| 474 | ELSKMQLFL | (SEQ ID NO: 270) |
| 395 | VPVTIPHAT | (SEQ ID NO: 271) |
| 183 | RGSADGAFL | (SEQ ID NO: 272) |
| 309 | HGGGARLDL | (SEQ ID NO: 273) |
| 232 | GRTVGAGSL | (SEQ ID NO: 274) |
| 37 | QRLLRQRRR | (SEQ ID NO: 275) |
| 443 | ARFLDKDGL | (SEQ ID NO: 276) |
| 258 | FREFEQLNR | (SEQ ID NO: 277) |
| 145 | RRAAHSMMR | (SEQ ID NO: 278) |
| 79 | RRYGDVFQI | (SEQ ID NO: 279) |
| 347 | TRYPDVQTR | (SEQ ID NO: 280) |
| 467 | KRRCIGEEL | (SEQ ID NO: 281) |
| 265 | NRNFSNFIL | (SEQ ID NO: 282) |
| 116 | DRPAFASFR | (SEQ ID NO: 283) |
| 514 | KSFKVNVTL | (SEQ ID NO: 284) |
| 469 | RCIGEELSK | (SEQ ID NO: 285) |
| 182 | VRGSADGAF | (SEQ ID NO: 286) |
| 129 | GRSMAFGHY | (SEQ ID NO: 287) |
| 47 | LRSAPPGPF | (SEQ ID NO: 288) |
| 40 | LRQRRRQLR | (SEQ ID NO: 289) |
| 175 | RELVALLVR | (SEQ ID NO: 290) |
| 144 | QRRAAHSMM | (SEQ ID NO: 291) |
| 39 | LLRQRRRQL | (SEQ ID NO: 292) |
| 525 | SMELLDSAV | (SEQ ID NO: 293) |
| 337 | TALQWLLLL | (SEQ ID NO: 294) |
| 246 | WLQYFPNPV | (SEQ ID NO: 295) |
| 235 | VGAGSLVDV | (SEQ ID NO: 296) |
| 172 | SEARELVAL | (SEQ ID NO: 297) |
| 23 | LLLLLSVLA | (SEQ ID NO: 298) |
| 470 | CIGEELSKM | (SEQ ID NO: 299) |
| 380 | YVLAFLYEA | (SEQ ID NO: 300) |
| 316 | DLENVPATI | (SEQ ID NO: 301) |
| 292 | MMDAFILSA | (SEQ ID NO: 302) |
| 173 | EARELVALL | (SEQ ID NO: 303) |
| 88 | RLGSCPIVV | (SEQ ID NO: 304) |
| 64 | AAVGQAAHL | (SEQ ID NO: 305) |
| 520 | VTLRESMEL | (SEQ ID NO: 306) |
| 336 | STALQWLLL | (SEQ ID NO: 307) |
| 312 | GARLDLENV | (SEQ ID NO: 308) |
| 249 | YFPNPVRTV | (SEQ ID NO: 309) |
| 200 | AVANVMSAV | (SEQ ID NO: 310) |
| 165 | VLEGHVLSE | (SEQ ID NO: 311) |
| 89 | LGSCPIVVL | (SEQ ID NO: 312) |
| 15 | PLSIQQTTL | (SEQ ID NO: 313) |
| 481 | FLFISILAH | (SEQ ID NO: 314) |
| 474 | ELSKMQLFL | (SEQ ID NO: 315) |
| 419 | VVFVNQWSV | (SEQ ID NO: 316) |
| 414 | IPKDTVVFV | (SEQ ID NO: 317) |
| 381 | VLAFLYEAM | (SEQ ID NO: 318) |
| 373 | GDQPNLPYV | (SEQ ID NO: 319) |

-continued

| | | |
|---|---|---|
| 355 | RVQAELDQV | (SEQ ID NO: 320) |
| 338 | ALQWLLLLF | (SEQ ID NO: 321) |
| 282 | SLRPGAAPR | (SEQ ID NO: 322) |
| 169 | HVLSEAREL | (SEQ ID NO: 323) |
| 95 | VVLNGERAI | (SEQ ID NO: 324) |
| 86 | QLRLGSCPI | (SEQ ID NO: 325) |
| 69 | AAHLSFARL | (SEQ ID NO: 326) |
| 451 | LINKDLTSR | (SEQ ID NO: 327) |
| 450 | GLINKDLTS | (SEQ ID NO: 328) |
| 412 | YHIPKDTVV | (SEQ ID NO: 329) |
| 409 | VLGYHIPKD | (SEQ ID NO: 330) |
| 402 | ATTANTSVL | (SEQ ID NO: 331) |
| 342 | LLLLFTRYP | (SEQ ID NO: 332) |
| 322 | ATLTDLFGA | (SEQ ID NO: 333) |
| 272 | ILDKFLRHC | (SEQ ID NO: 334) |
| 191 | LDPRPLTVV | (SEQ ID NO: 335) |
| 87 | IRLGSCPIV | (SEQ ID NO: 336) |
| 55 | FAWPLIGNA | (SEQ ID NO: 337) |
| 18 | IQQTTLLLL | (SEQ ID NO: 338) |
| 514 | KSFKVNVTL | (SEQ ID NO: 339) |
| 501 | AKMNFSYGL | (SEQ ID NO: 340) |
| 460 | VMIFSVGKR | (SEQ ID NO: 341) |
| 457 | TSRVMIFSV | (SEQ ID NO: 342) |
| 356 | VQAELDQVV | (SEQ ID NO: 343) |
| 319 | NVPATLTDI | (SEQ ID NO: 344) |
| 315 | LDLENVPAT | (SEQ ID NO: 345) |
| 314 | RLDLENVPA | (SEQ ID NO: 346) |
| 297 | ILSAEKKAA | (SEQ ID NO: 347) |
| 296 | FILSAEKKA | (SEQ ID NO: 348) |
| 233 | RTVGAGSLV | (SEQ ID NO: 349) |
| 188 | GAFLDPRPL | (SEQ ID NO: 350) |
| 324 | ITDIFGASQ | (SEQ ID NO: 351) |
| 258 | FREFEQLNR | (SEQ ID NO: 352) |
| 216 | HDDPEFREL | (SEQ ID NO: 353) |
| 73 | SFARLARRY | (SEQ ID NO: 354) |
| 499 | EPAKMNFSY | (SEQ ID NO: 355) |
| 292 | MMDAFILSA | (SEQ ID NO: 356) |
| 137 | YSEHWKVQR | (SEQ ID NO: 357) |
| 81 | YGDVFQIRL | (SEQ ID NO: 358) |
| 349 | YPDVQTRVQ | (SEQ ID NO: 359) |
| 497 | PNEPAKMNF | (SEQ ID NO: 360) |
| 428 | NHDPLKWPN | (SEQ ID NO: 361) |
| 415 | PKDTVVFVN | (SEQ ID NO: 362) |
| 359 | ELDQVVGRD | (SEQ ID NO: 363) |
| 228 | NEEFGRTVG | (SEQ ID NO: 364) |
| 20 | QTTLLLLLS | (SEQ ID NO: 365) |
| 530 | DSAVQNLQA | (SEQ ID NO: 366) |
| 447 | DKDGLINKD | (SEQ ID NO: 367) |
| 316 | DLENVPATI | (SEQ ID NO: 368) |
| 215 | SHDDPEFRE | (SEQ ID NO: 369) |
| 33 | VHVGQRLLR | (SEQ ID NO: 370) |
| 528 | LLDSAVQNL | (SEQ ID NO: 371) |
| 525 | SMELLDSAV | (SEQ ID NO: 372) |
| 505 | FSYGLTIKP | (SEQ ID NO: 373) |
| 456 | LTSRVMIFS | (SEQ ID NO: 374) |
| 393 | SFVPVTIPH | (SEQ ID NO: 375) |
| 376 | PNLPYVLAF | (SEQ ID NO: 376) |
| 333 | DTLSTALQW | (SEQ ID NO: 377) |
| 331 | SQDTLSTAL | (SEQ ID NO: 378) |
| 314 | RLDLENVPA | (SEQ ID NO: 379) |
| 305 | AGDSHGGGA | (SEQ ID NO: 380) |
| 299 | SAEKKAAGD | (SEQ ID NO: 381) |
| 240 | LVDVMPWLQ | (SEQ ID NO: 382) |
| 114 | FADRPAFAS | (SEQ ID NO: 383) |
| 21 | TTLLLLLSV | (SEQ ID NO: 384) |
| 476 | SKMQLFLFI | (SEQ ID NO: 385) |
| 471 | IGEELSKMQ | (SEQ ID NO: 386) |
| 453 | NKDLTSRVM | (SEQ ID NO: 387) |
| 397 | VTIPHATTA | (SEQ ID NO: 388) |
| 385 | LYEAMRFSS | (SEQ ID NO: 389) |
| 365 | GRDRLPCMG | (SEQ ID NO: 390) |
| 357 | QAELDQVVG | (SEQ ID NO: 391) |
| 279 | HCESLRPGA | (SEQ ID NO: 392) |
| 272 | ILDKFLRHC | (SEQ ID NO: 393) |
| 260 | EFEQLNRNF | (SEQ ID NO: 394) |
| 227 | HNEEFGRTV | (SEQ ID NO: 395) |
| 221 | FRELLSHNE | (SEQ ID NO: 396) |
| 91 | SCPIVVLNG | (SEQ ID NO: 397) |
| 90 | GSCPIVVLN | (SEQ ID NO: 398) |
| 490 | QCDFRANPN | (SEQ ID NO: 399) |
| 472 | GEELSKMQL | (SEQ ID NO: 400) |
| 440 | FDPARFLDK | (SEQ ID NO: 401) |
| 436 | NPENFDPAR | (SEQ ID NO: 402) |
| 426 | SVNHDPLKW | (SEQ ID NO: 403) |
| 353 | QTRVQAELD | (SEQ ID NO: 404) |
| 338 | ALQWLLLLF | (SEQ ID NO: 405) |
| 289 | PRDMMDAFI | (SEQ ID NO: 406) |
| 271 | FILDKFLRH | (SEQ ID NO: 407) |
| 233 | RTVGAGSLV | (SEQ ID NO: 408) |
| 98 | NGERAIHQA | (SEQ ID NO: 409) |
| 14 | NPLSIQQTT | (SEQ ID NO: 410) |
| 438 | ENFDPARFL | (SEQ ID NO: 411) |
| 402 | ATTANTSVL | (SEQ ID NO: 412) |
| 173 | EARELVALL | (SEQ ID NO: 413) |
| 64 | AAVGQAAHL | (SEQ ID NO: 414) |
| 48 | RSAPPGPFA | (SEQ ID NO: 415) |
| 514 | KSFKVNVTL | (SEQ ID NO: 416) |
| 467 | KRRCIGEEL | (SEQ ID NO: 417) |
| 370 | PCMGDQPNL | (SEQ ID NO: 418) |
| 307 | DSHGGGARL | (SEQ ID NO: 419) |
| 172 | SEARELVAL | (SEQ ID NO: 420) |
| 159 | QPRSRQVLE | (SEQ ID NO: 421) |
| 99 | GERAIHQAL | (SEQ ID NO: 422) |
| 69 | AAHLSFARL | (SEQ ID NO: 423) |
| 8 | NDPWPLNPL | (SEQ ID NO: 424) |
| 6 | SPNDPWPLN | (SEQ ID NO: 425) |
| 501 | AKMNFSYGL | (SEQ ID NO: 426) |
| 499 | EPAKMNFSY | (SEQ ID NO: 427) |
| 496 | NPNEPAKMN | (SEQ ID NO: 428) |
| 424 | QWSVNHDPL | (SEQ ID NO: 429) |
| 349 | YPDVQTRVQ | (SEQ ID NO: 430) |
| 346 | FTRYPDVQT | (SEQ ID NO: 431) |
| 336 | STALQWLLL | (SEQ ID NO: 432) |
| 331 | SQDTLSTAL | (SEQ ID NO: 433) |
| 327 | IFGASQDTL | (SEQ ID NO: 434) |
| 284 | RPGAAPRDM | (SEQ ID NO: 435) |
| 216 | HDDPEFREL | (SEQ ID NO: 436) |
| 189 | AFLDPRPLT | (SEQ ID NO: 437) |
| 163 | RQVLEGHVL | (SEQ ID NO: 438) |
| 158 | RQPRSRQVL | (SEQ ID NO: 439) |
| 115 | ADRPAFASF | (SEQ ID NO: 440) |
| 53 | GPFAWPLIG | (SEQ ID NO: 441) |
| 47 | LRSAPPGPF | (SEQ ID NO: 442) |
| 39 | LLRQRRRQL | (SEQ ID NO: 443) |
| 31 | ATVHVGQRL | (SEQ ID NO: 444) |
| 18 | IQQTTLLLL | (SEQ ID NO: 445) |
| 17 | SIQQTTLLL | (SEQ ID NO: 446) |
| 15 | PLSIQQTTL | (SEQ ID NO: 447) |
| 11 | WPLNPLSIQ | (SEQ ID NO: 448) |
| 528 | LLDSAVQNL | (SEQ ID NO: 449) |
| 521 | TLRESMELL | (SEQ ID NO: 450) |
| 448 | KDGLINKDL | (SEQ ID NO: 451) |
| 443 | ARFLDKDGL | (SEQ ID NO: 452) |
| 436 | NPENFDPAR | (SEQ ID NO: 453) |
| 430 | DPLKWPNPE | (SEQ ID NO: 454) |
| 390 | RFSSFVPVT | (SEQ ID NO: 455) |
| 377 | NLPYVLAFL | (SEQ ID NO: 456) |
| 337 | TALQWLLLL | (SEQ ID NO: 457) |
| 334 | TLSTALQWL | (SEQ ID NO: 458) |
| 290 | RDMMDAFIL | (SEQ ID NO: 459) |
| 229 | EEFGRTVGA | (SEQ ID NO: 460) |
| 218 | DPEFRELLS | (SEQ ID NO: 461) |
| 148 | AHSMMRNFF | (SEQ ID NO: 462) |
| 19 | QQTTLLLLL | (SEQ ID NO: 463) |
| 16 | LSIQQTTLL | (SEQ ID NO: 464) |
| 9 | DPWPLNPLS | (SEQ ID NO: 465) |
| 493 | FRANPNEPA | (SEQ ID NO: 466) |
| 476 | SKMQLFLFI | (SEQ ID NO: 467) |
| 441 | DPARFLDKD | (SEQ ID NO: 468) |
| 479 | QLFLFLSLL | (SEQ ID NO: 469) |
| 472 | GEELSKMQL | (SEQ ID NO: 470) |
| 383 | AFLYEAMRF | (SEQ ID NO: 471) |
| 295 | AFILSAEKK | (SEQ ID NO: 472) |
| 289 | PRDMMDAFI | (SEQ ID NO: 473) |
| 163 | RQVLEGHVL | (SEQ ID NO: 474) |
| 43 | RRRQLRSAP | (SEQ ID NO: 475) |
| 509 | LTIKPKSFK | (SEQ ID NO: 476) |
| 370 | PCMGDQPNL | (SEQ ID NO: 477) |

-continued

| | | |
|---|---|---|
| 307 | DSHGGGARL | (SEQ ID NO: 478) |
| 294 | DAFILSAEK | (SEQ ID NO: 479) |
| 213 | RYSHDDPEF | (SEQ ID NO: 480) |
| 188 | GAFLDPRPL | (SEQ ID NO: 481) |
| 153 | RNFFTRQPR | (SEQ ID NO: 482) |
| 87 | IRLGSCPIV | (SEQ ID NO: 483) |
| 72 | LSFARLARR | (SEQ ID NO: 484) |
| 44 | RRQLRSAPP | (SEQ ID NO: 485) |
| 36 | GQRLLRQRR | (SEQ ID NO: 486) |
| 22 | TLLLLLSVL | (SEQ ID NO: 487) |
| 520 | VTLRESMEL | (SEQ ID NO: 488) |
| 494 | RANPNEPAK | (SEQ ID NO: 489) |
| 481 | FLFLSLLAH | (SEQ ID NO: 490) |
| 468 | RRCIGEELS | (SEQ ID NO: 491) |
| 461 | MIFSVGKRR | (SEQ ID NO: 492) |
| 460 | VMIFSVGKR | (SEQ ID NO: 493) |
| 459 | RVMIFSVGK | (SEQ ID NO: 494) |
| 451 | LINKDLTSR | (SEQ ID NO: 495) |
| 446 | LDKDGLINK | (SEQ ID NO: 496) |
| 341 | WLLLLFTRY | (SEQ ID NO: 497) |
| 340 | QWLLLLFTR | (SEQ ID NO: 498) |
| 337 | TALQWLLLL | (SEQ ID NO: 499) |
| 313 | ARLDLENVP | (SEQ ID NO: 500) |
| 283 | LRPGAAPRD | (SEQ ID NO: 501) |
| 260 | EFEQLNRNF | (SEQ ID NO: 502) |
| 247 | LQYFPNPVR | (SEQ ID NO: 503) |
| 161 | RSRQVLEGH | (SEQ ID NO: 504) |
| 158 | RQPRSRQVL | (SEQ ID NO: 505) |
| 124 | RVVSGGRSM | (SEQ ID NO: 506) |
| 89 | LGSCPIVVL | (SEQ ID NO: 507) |
| 69 | AAHLSFARL | (SEQ ID NO: 508) |
| 64 | AAVGQAAHL | (SEQ ID NO: 509) |
| 16 | LSIQQTTLL | (SEQ ID NO: 510) |
| 508 | GLTIKPKSF | (SEQ ID NO: 511) |
| 504 | NFSYGLTIK | (SEQ ID NO: 512) |
| 497 | PNEPAKMNF | (SEQ ID NO: 513) |
| 474 | ELSKMQLFL | (SEQ ID NO: 514) |
| 448 | KDGLINKDL | (SEQ ID NO: 515) |
| 438 | ENFDPARFL | (SEQ ID NO: 516) |
| 408 | SVLGYHIPK | (SEQ ID NO: 517) |
| 389 | MRFSSFVPV | (SEQ ID NO: 518) |
| 382 | LAFLYEAMR | (SEQ ID NO: 519) |
| 376 | PNLPYVLAF | (SEQ ID NO: 520) |
| 361 | DQVVGRDRL | (SEQ ID NO: 521) |
| 358 | AELDQVVGR | (SEQ ID NO: 522) |
| 352 | VQTRVQAEL | (SEQ ID NO: 523) |
| 327 | IFGASQDTL | (SEQ ID NO: 524) |
| 306 | GDSHGGGAR | (SEQ ID NO: 525) |
| 290 | RDMMDAFIL | (SEQ ID NO: 526) |
| 282 | SLRPGAAPR | (SEQ ID NO: 527) |
| 180 | LLVRGSADG | (SEQ ID NO: 528) |
| 131 | SMAFGHYSE | (SEQ ID NO: 529) |
| 102 | AIHQALVQQ | (SEQ ID NO: 530) |
| 96 | VLNGERAIH | (SEQ ID NO: 531) |
| 32 | TVHVGQRLL | (SEQ ID NO: 532) |
| 31 | ATVHVGQRL | (SEQ ID NO: 533) |
| 29 | VLATVHVGQ | (SEQ ID NO: 534) |
| 27 | LSVLATVHV | (SEQ ID NO: 535) |
| 16 | LSIQQTTLL | (SEQ ID NO: 536) |
| 8 | NDPWPLNPL | (SEQ ID NO: 537) |
| 452 | INKDLTSRV | (SEQ ID NO: 538) |
| 401 | HATTANTSV | (SEQ ID NO: 539) |
| 397 | VTIPHATTA | (SEQ ID NO: 540) |
| 307 | DSHGGGARL | (SEQ ID NO: 541) |
| 275 | KFLRHCESL | (SEQ ID NO: 542) |
| 256 | TVFREFEQL | (SEQ ID NO: 543) |
| 199 | VAVANVMSA | (SEQ ID NO: 544) |
| 179 | ALLVRGSAD | (SEQ ID NO: 545) |
| 79 | RRYGDVFQI | (SEQ ID NO: 546) |
| 19 | QQTTLLLLL | (SEQ ID NO: 547) |
| 4 | SLSPNDPWP | (SEQ ID NO: 548) |
| 486 | ILAHQCDFR | (SEQ ID NO: 549) |
| 477 | KMQLFLFIS | (SEQ ID NO: 550) |
| 443 | ARFLDKDGL | (SEQ ID NO: 551) |
| 411 | GYHIPKDTV | (SEQ ID NO: 552) |
| 406 | NTSVLGYHI | (SEQ ID NO: 553) |
| 394 | FVPVTIPHA | (SEQ ID NO: 554) |
| 384 | FLYEAMRFS | (SEQ ID NO: 555) |
| 352 | VQTRVQAEL | (SEQ ID NO: 556) |
| 343 | LLLFTRYPD | (SEQ ID NO: 557) |
| 331 | SQDTLSTAL | (SEQ ID NO: 558) |
| 329 | GASQDTLST | (SEQ ID NO: 559) |
| 327 | IFGASQDTL | (SEQ ID NO: 560) |
| 326 | DIFGASQDT | (SEQ ID NO: 561) |
| 271 | FILDKFLRH | (SEQ ID NO: 562) |
| 236 | GAGSLVDVM | (SEQ ID NO: 563) |
| 232 | GRTVGAGSL | (SEQ ID NO: 564) |
| 227 | HNEEFGRTV | (SEQ ID NO: 565) |
| 216 | HDDPEFREL | (SEQ ID NO: 566) |
| 193 | PRPLTVVAV | (SEQ ID NO: 567) |
| 177 | LVALLVRGS | (SEQ ID NO: 568) |
| 176 | ELVALLVRG | (SEQ ID NO: 569) |
| 135 | GHYSEHWKV | (SEQ ID NO: 570) |
| 107 | LVQQGSAFA | (SEQ ID NO: 571) |
| 512 | KPKSFKVNV | (SEQ ID NO: 572) |
| 503 | MNFSYGLTI | (SEQ ID NO: 573) |
| 502 | KMNFSYGLT | (SEQ ID NO: 574) |
| 476 | SKMQLFLFI | (SEQ ID NO: 575) |
| 467 | KRRCIGEEL | (SEQ ID NO: 576) |
| 454 | KDLTSRVMI | (SEQ ID NO: 577) |
| 389 | MRFSSFVPV | (SEQ ID NO: 578) |
| 387 | EAMRFSSFV | (SEQ ID NO: 579) |
| 341 | WLLLLFTRY | (SEQ ID NO: 580) |
| 339 | LQWLLLLFT | (SEQ ID NO: 581) |
| 330 | ASQDTLSTA | (SEQ ID NO: 582) |
| 309 | HGGGARLDL | (SEQ ID NO: 583) |
| 269 | SNFILDKFL | (SEQ ID NO: 584) |
| 181 | LVRGSADGA | (SEQ ID NO: 585) |
| 178 | VALLVRGSA | (SEQ ID NO: 586) |
| 48 | RSAPPGPFA | (SEQ ID NO: 587) |
| 31 | ATVHVGQRL | (SEQ ID NO: 588) |
| 17 | SIQQTTLLL | (SEQ ID NO: 589) |
| 516 | FKVNVTLRE | (SEQ ID NO: 590) |
| 379 | PYVLAFLYE | (SEQ ID NO: 591) |
| 291 | DMMDAFILS | (SEQ ID NO: 592) |
| 282 | SLRPGAAPR | (SEQ ID NO: 593) |
| 266 | RNFSNFILD | (SEQ ID NO: 594) |
| 250 | FPNPVRTVE | (SEQ ID NO: 595) |
| 234 | TVGAGSLVD | (SEQ ID NO: 596) |
| 160 | PRSRQVLEG | (SEQ ID NO: 597) |
| 156 | FTRQPRSRQ | (SEQ ID NO: 598) |
| 101 | RAIHQALVQ | (SEQ ID NO: 599) |
| 12 | PLNPLSIQQ | (SEQ ID NO: 600) |
| 503 | MNFSYGLTI | (SEQ ID NO: 601) |
| 481 | FLFLSLLAH | (SEQ ID NO: 602) |
| 475 | LSKMQLFLF | (SEQ ID NO: 603) |
| 408 | SVLGYHIPK | (SEQ ID NO: 604) |
| 403 | TTANTSVLG | (SEQ ID NO: 605) |
| 402 | ATTANTSVL | (SEQ ID NO: 606) |
| 392 | SSFVPVTIP | (SEQ ID NO: 607) |
| 363 | VVGRDRLPC | (SEQ ID NO: 608) |
| 346 | FTRYPDVQT | (SEQ ID NO: 609) |
| 337 | TALQWLLLL | (SEQ ID NO: 610) |
| 318 | ENVPATITD | (SEQ ID NO: 611) |
| 309 | HGGGARLDL | (SEQ ID NO: 612) |
| 307 | DSHGGGARL | (SEQ ID NO: 613) |
| 184 | GSADGAFLD | (SEQ ID NO: 614) |
| 121 | ASFRVVSGG | (SEQ ID NO: 615) |
| 115 | ADRPAFASF | (SEQ ID NO: 616) |
| 71 | HLSFARLAR | (SEQ ID NO: 617) |
| 49 | SAPPGPFAW | (SEQ ID NO: 618) |
| 24 | LLLLSVLAT | (SEQ ID NO: 619) |
| 19 | QQTTLLLLL | (SEQ ID NO: 620) |
| 18 | IQQTTLLLL | (SEQ ID NO: 621) |
| 16 | LSIQQTTLL | (SEQ ID NO: 622) |
| 520 | VTLRESMEL | (SEQ ID NO: 623) |
| 514 | KSFKVNVTL | (SEQ ID NO: 624) |
| 509 | LTIKPKSFK | (SEQ ID NO: 625) |
| 478 | MQLFLFLSI | (SEQ ID NO: 626) |
| 474 | ELSKMQLFL | (SEQ ID NO: 627) |
| 469 | RCIGEELSK | (SEQ ID NO: 628) |
| 463 | FSVGKRRCI | (SEQ ID NO: 629) |
| 450 | GLINKDLTS | (SEQ ID NO: 630) |
| 417 | DTVVFVNQW | (SEQ ID NO: 631) |
| 412 | YHIPKDTVV | (SEQ ID NO: 632) |
| 406 | NTSVLGYHI | (SEQ ID NO: 633) |
| 391 | FSSFVPVTI | (SEQ ID NO: 634) |
| 322 | ATLTDLFGA | (SEQ ID NO: 635) |

| | | |
|---|---|---|
| 308 | SHGGGARLD | (SEQ ID NO: 636) |
| 268 | FSNFILDKF | (SEQ ID NO: 637) |
| 205 | MSAVCFGCR | (SEQ ID NO: 638) |
| 196 | LTVVAVANV | (SEQ ID NO: 639) |
| 175 | RELVALLVR | (SEQ ID NO: 640) |
| 83 | DVFQIRLGS | (SEQ ID NO: 641) |
| 66 | VGQAAHLSF | (SEQ ID NO: 642) |
| 9 | DPWPLNPLS | (SEQ ID NO: 643) |
| 4 | SLSPNDPWP | (SEQ ID NO: 644) |
| 523 | RESMELLDS | (SEQ ID NO: 645) |
| 434 | WPNPENFDP | (SEQ ID NO: 646) |
| 413 | HIPKDTVVF | (SEQ ID NO: 647) |
| 376 | PNLPYVLAF | (SEQ ID NO: 648) |
| 374 | DQPNLPYVL | (SEQ ID NO: 649) |
| 369 | LPCMGDQPN | (SEQ ID NO: 650) |
| 361 | DQVVGRDRL | (SEQ ID NO: 651) |
| 352 | VQTRVQAEL | (SEQ ID NO: 652) |
| 335 | LSTALQWLL | (SEQ ID NO: 653) |
| 329 | GASQDTLST | (SEQ ID NO: 654) |
| 314 | RLDLENVPA | (SEQ ID NO: 655) |
| 297 | ILSAEKKAA | (SEQ ID NO: 656) |
| 275 | KFLRHCESL | (SEQ ID NO: 657) |
| 269 | SNFILDKFL | (SEQ ID NO: 658) |
| 256 | TVFREFEQL | (SEQ ID NO: 659) |
| 252 | NPVRTVFRE | (SEQ ID NO: 660) |
| 244 | MPWLQYFPN | (SEQ ID NO: 661) |
| 239 | SLVDVMPWL | (SEQ ID NO: 662) |
| 235 | VGAGSLVDV | (SEQ ID NO: 663) |
| 217 | DDPEFRELL | (SEQ ID NO: 664) |
| 191 | LDPRPLTVV | (SEQ ID NO: 665) |
| 188 | GAFLDPRPL | (SEQ ID NO: 666) |
| 125 | VVSGGRSMA | (SEQ ID NO: 667) |
| 113 | AFADRPAFA | (SEQ ID NO: 668) |
| 81 | YGDVFQIRL | (SEQ ID NO: 669) |
| 22 | TLLLLLSVL | (SEQ ID NO: 670) |
| 5 | LSPNDPWPL | (SEQ ID NO: 671) |
| 520 | VTLRESMEL | (SEQ ID NO: 672) |
| 513 | PKSFKVNVT | (SEQ ID NO: 673) |
| 479 | QLFLFLSLL | (SEQ ID NO: 674) |
| 472 | GEELSKMQL | (SEQ ID NO: 675) |
| 454 | KDLTSRVMI | (SEQ ID NO: 676) |
| 396 | PVTIPHATT | (SEQ ID NO: 677) |
| 391 | FSSFVPVTI | (SEQ ID NO: 678) |
| 389 | MRFSSFVPV | (SEQ ID NO: 679) |
| 378 | LPYVLAFLY | (SEQ ID NO: 680) |
| 338 | ALQWLLLLF | (SEQ ID NO: 681) |
| 317 | LENVPATIT | (SEQ ID NO: 682) |
| 305 | AGDSHGGGA | (SEQ ID NO: 683) |
| 292 | MMDAFILSA | (SEQ ID NO: 684) |
| 265 | NRNFSNFIL | (SEQ ID NO: 685) |
| 249 | YFPNPVRTV | (SEQ ID NO: 686) |
| 233 | RTVGAGSLV | (SEQ ID NO: 687) |
| 232 | GRTVGAGSL | (SEQ ID NO: 688) |
| 213 | RYSHDDPEF | (SEQ ID NO: 689) |
| 202 | ANVMSAVCF | (SEQ ID NO: 690) |
| 200 | AVANVMSAV | (SEQ ID NO: 691) |
| 193 | PRPLTVVAV | (SEQ ID NO: 692) |
| 190 | FLDPRPLTV | (SEQ ID NO: 693) |
| 181 | LVRGSADGA | (SEQ ID NO: 694) |
| 174 | ARELVALLV | (SEQ ID NO: 695) |
| 171 | LSEARELVA | (SEQ ID NO: 696) |
| 169 | HVLSEAREL | (SEQ ID NO: 697) |
| 126 | VSGGRSMAF | (SEQ ID NO: 698) |
| 112 | SAFADRPAF | (SEQ ID NO: 699) |
| 106 | ALVQQGSAF | (SEQ ID NO: 700) |
| 92 | CPIVVLNGE | (SEQ ID NO: 701) |
| 87 | IRLGSCPIV | (SEQ ID NO: 702) |
| 79 | RRYGDVFQI | (SEQ ID NO: 703) |
| 77 | LARRYGDVF | (SEQ ID NO: 704) |
| 277 | LRHCESLRP | (SEQ ID NO: 705) |
| 275 | KFLRHCESL | (SEQ ID NO: 706) |
| 269 | SNFILDKFL | (SEQ ID NO: 707) |
| 256 | TVFREFEQL | (SEQ ID NO: 708) |
| 250 | FPNPVRTVF | (SEQ ID NO: 709) |
| 221 | FRELLSHNE | (SEQ ID NO: 710) |
| 219 | PEFRELLSH | (SEQ ID NO: 711) |
| 208 | VCFGCRYSH | (SEQ ID NO: 712) |
| 202 | ANVMSAVCF | (SEQ ID NO: 713) |
| 183 | RGSADGAFL | (SEQ ID NO: 714) |
| 174 | ARELVALLV | (SEQ ID NO: 715) |
| 169 | HVLSEAREL | (SEQ ID NO: 716) |
| 132 | MAFGHYSEH | (SEQ ID NO: 717) |
| 106 | ALVQQGSAF | (SEQ ID NO: 718) |
| 81 | YGDVFQIRL | (SEQ ID NO: 719) |
| 80 | RYGDVFQIR | (SEQ ID NO: 720) |
| 78 | ARRYGDVFQ | (SEQ ID NO: 721) |
| 31 | ATVHVGQRL | (SEQ ID NO: 722) |
| 15 | PLSIQQTTL | (SEQ ID NO: 723) |
| 531 | SAVQNLQAK | (SEQ ID NO: 724) |
| 506 | SYGLTIKPK | (SEQ ID NO: 725) |
| 485 | SILAHQCDF | (SEQ ID NO: 726) |
| 470 | CIGEELSKM | (SEQ ID NO: 727) |
| 458 | SRVMIFSVG | (SEQ ID NO: 728) |
| 444 | RFLDKDGLI | (SEQ ID NO: 729) |
| 421 | FVNQWSVNH | (SEQ ID NO: 730) |
| 413 | HIPKDTVVF | (SEQ ID NO: 731) |
| 365 | GRDRLPCMG | (SEQ ID NO: 732) |
| 354 | TRVQAELDQ | (SEQ ID NO: 733) |
| 338 | ALQWLLLLF | (SEQ ID NO: 734) |
| 335 | LSTALQWLL | (SEQ ID NO: 735) |
| 331 | SQDTLSTAL | (SEQ ID NO: 736) |
| 271 | FILDKFLRH | (SEQ ID NO: 737) |
| 270 | NFILDKFLR | (SEQ ID NO: 738) |
| 268 | FSNFILDKF | (SEQ ID NO: 739) |
| 267 | NFSNFILDK | (SEQ ID NO: 740) |
| 236 | GAGSLVDVM | (SEQ ID NO: 741) |
| 223 | ELLSHNEEF | (SEQ ID NO: 742) |
| 173 | EARELVALL | (SEQ ID NO: 743) |
| 138 | SEHWKVQRR | (SEQ ID NO: 744) |
| 126 | VSGGRSMAF | (SEQ ID NO: 745) |
| 123 | FRVVSGGRS | (SEQ ID NO: 746) |
| 115 | ADRPAFASF | (SEQ ID NO: 747) |
| 112 | SAFADRPAF | (SEQ ID NO: 748) |
| 99 | GERAIHQAL | (SEQ ID NO: 749) |
| 93 | PIVVLNGER | (SEQ ID NO: 750) |
| 75 | ARLARRYGD | (SEQ ID NO: 751) |
| 63 | AAAVGQAAH | (SEQ ID NO: 752) |
| 33 | VHVGQRLLR | (SEQ ID NO: 753) |
| 32 | TVHVGQRLL | (SEQ ID NO: 754) |
| 528 | LLDSAVQNL | (SEQ ID NO: 755) |
| 515 | SFKVNVTLR | (SEQ ID NO: 756) |
| 501 | AKMNFSYGL | (SEQ ID NO: 757) |
| 495 | ANPNEPAKM | (SEQ ID NO: 758) |
| 473 | EELSKMQLF | (SEQ ID NO: 759) |
| 437 | PENFDPARF | (SEQ ID NO: 760) |
| 432 | LKWPNPENF | (SEQ ID NO: 761) |
| 425 | WSVNHDPLK | (SEQ ID NO: 762) |
| 402 | ATTANTSVL | (SEQ ID NO: 763) |
| 162 | SRQVLEGHV | (SEQ ID NO: 764) |
| 150 | SMMRNFFTR | (SEQ ID NO: 765) |
| 125 | WSGGRSMA | (SEQ ID NO: 766) |
| 106 | ALVQQGSAF | (SEQ ID NO: 767) |
| 81 | YGDVFQIRL | (SEQ ID NO: 768) |
| 63 | AAAVGQAAH | (SEQ ID NO: 769) |
| 28 | SVLATVHVG | (SEQ ID NO: 770) |
| 26 | LLSVLATVH | (SEQ ID NO: 771) |
| 527 | ELLDSAVQN | (SEQ ID NO: 772) |
| 517 | KVNVTLRES | (SEQ ID NO: 773) |
| 508 | GLTIKPKSF | (SEQ ID NO: 774) |
| 485 | SILAHQCDF | (SEQ ID NO: 775) |
| 478 | MQLFLFLSI | (SEQ ID NO: 776) |
| 463 | FSVGKRRCI | (SEQ ID NO: 777) |
| 455 | DLTSRVMIF | (SEQ ID NO: 778) |
| 445 | FLDKDGLIN | (SEQ ID NO: 779) |
| 444 | RFLDKDGLI | (SEQ ID NO: 780) |
| 413 | HIPKDTVVF | (SEQ ID NO: 781) |
| 391 | FSSFVPVTI | (SEQ ID NO: 782) |
| 358 | AELDQVVGR | (SEQ ID NO: 783) |
| 335 | LSTALQWLL | (SEQ ID NO: 784) |
| 264 | LNRNFSNFI | (SEQ ID NO: 785) |
| 224 | LLSHNEEFG | (SEQ ID NO: 786) |
| 217 | DDPEFRELL | (SEQ ID NO: 787) |
| 194 | RPLTVVAVA | (SEQ ID NO: 788) |
| 183 | RGSADGAFL | (SEQ ID NO: 789) |
| 174 | ARELVALLV | (SEQ ID NO: 790) |
| 166 | LEGHVLSEA | (SEQ ID NO: 791) |
| 164 | QVLEGHVLS | (SEQ ID NO: 792) |
| 157 | TRQPRSRQV | (SEQ ID NO: 793) |

-continued

| | | |
|---|---|---|
| 124 | RVVSGGRSM | (SEQ ID NO: 794) |
| 120 | FASFRVVSG | (SEQ ID NO: 795) |
| 118 | PAFASFRVV | (SEQ ID NO: 796) |
| 105 | QALVQQGSA | (SEQ ID NO: 797) |
| 99 | GERAIHQAL | (SEQ ID NO: 798) |
| 59 | LIGNAAAVG | (SEQ ID NO: 799) |
| 46 | QLRSAPPGP | (SEQ ID NO: 800) |
| 38 | RLLRQRRRQ | (SEQ ID NO: 801) |
| 5 | LSPNDPWPL | (SEQ ID NO: 802) |
| 535 | NLQAKETCQ | (SEQ ID NO: 803) |
| 532 | AVQNLQAKE | (SEQ ID NO: 804) |
| 531 | SAVQNLQAK | (SEQ ID NO: 805) |
| 524 | ESMELLDSA | (SEQ ID NO: 806) |
| 483 | FISILAHQC | (SEQ ID NO: 807) |
| 408 | SVLGYHIPK | (SEQ ID NO: 808) |
| 404 | TANTSVLGY | (SEQ ID NO: 809) |
| 398 | TIPHATTAN | (SEQ ID NO: 810) |
| 374 | DQPNLPYVL | (SEQ ID NO: 811) |
| 370 | PCMGDQPNL | (SEQ ID NO: 812) |
| 364 | VGRDRLPCM | (SEQ ID NO: 813) |
| 361 | DQVVGRDRL | (SEQ ID NO: 814) |
| 359 | ELDQVVGRD | (SEQ ID NO: 815) |
| 348 | RYPDVQTRV | (SEQ ID NO: 816) |
| 346 | FTRYPDVQT | (SEQ ID NO: 817) |
| 324 | ITDIFGASQ | (SEQ ID NO: 818) |
| 303 | KAAGDSHGG | (SEQ ID NO: 819) |
| 290 | RDMMDAFIL | (SEQ ID NO: 820) |
| 276 | FLRHCESLR | (SEQ ID NO: 821) |
| 263 | QLNRNFSNF | (SEQ ID NO: 822) |
| 510 | TIKPKSFKV | (SEQ ID NO: 823) |
| 480 | LFLFLSLLA | (SEQ ID NO: 824) |
| 458 | SRVMIFSVG | (SEQ ID NO: 825) |
| 446 | LDKDGLINK | (SEQ ID NO: 826) |
| 425 | WSVNHDPLK | (SEQ ID NO: 827) |
| 407 | TSVLGYHIP | (SEQ ID NO: 828) |
| 354 | TRVQAELDQ | (SEQ ID NO: 829) |
| 339 | LQWLLLLFT | (SEQ ID NO: 830) |
| 335 | LSTALQWLL | (SEQ ID NO: 831) |
| 329 | GASQDTLST | (SEQ ID NO: 832) |
| 311 | GGARLDLEN | (SEQ ID NO: 833) |
| 281 | ESLRPGAAP | (SEQ ID NO: 834) |
| 277 | LRHCESLRP | (SEQ ID NO: 835) |
| 267 | NFSNFILDK | (SEQ ID NO: 836) |
| 255 | RTVFREFEQ | (SEQ ID NO: 837) |
| 219 | PEFRELLSH | (SEQ ID NO: 838) |
| 214 | YSHDDPEFR | (SEQ ID NO: 839) |
| 161 | RSRQVLEGH | (SEQ ID NO: 840) |
| 126 | VSGGRSMAF | (SEQ ID NO: 841) |
| 125 | VVSGGRSMA | (SEQ ID NO: 842) |
| 88 | RLGSCPIVV | (SEQ ID NO: 843) |
| 53 | GPFAWPLIG | (SEQ ID NO: 844) |
| 50 | APPGPFAWP | (SEQ ID NO: 845) |
| 41 | RQRRQLRS | (SEQ ID NO: 846) |
| 34 | HVG-QRLLRQ | (SEQ ID NO: 847) |
| 10 | PWPLNPLSI | (SEQ ID NO: 848) |
| 3 | TSLSPNDPW | (SEQ ID NO: 849) |
| 2 | GTSLSPNDP | (SEQ ID NO: 850) |
| 515 | SFKVNVTLR | (SEQ ID NO: 851) |
| 465 | VGKRRCIGE | (SEQ ID NO: 852) |
| 434 | WPNENFDP | (SEQ ID NO: 853) |
| 416 | KDTVVFVNQ | (SEQ ID NO: 854) |
| 386 | YEAMRFSSF | (SEQ ID NO: 855) |
| 347 | TRYPDVQTR | (SEQ ID NO: 856) |
| 330 | ASQDTLSTA | (SEQ ID NO: 857) |
| 328 | FGASQDTLS | (SEQ ID NO: 858) |
| 286 | GAAPRDMMD | (SEQ ID NO: 859) |
| 253 | PVRTVFREF | (SEQ ID NO: 860) |
| 239 | SLVDVMPWL | (SEQ ID NO: 861) |
| 238 | GSLVDVMPW | (SEQ ID NO: 862) |
| 226 | SHNEEFGRT | (SEQ ID NO: 863) |
| 192 | DPRPLTVVA | (SEQ ID NO: 864) |
| 189 | AFLDPRPLT | (SEQ ID NO: 865) |
| 170 | VLSEARELV | (SEQ ID NO: 866) |
| 150 | SMMRNFFTR | (SEQ ID NO: 867) |
| 149 | HSMMRNFFT | (SEQ ID NO: 868) |
| 130 | RSMAFGHYS | (SEQ ID NO: 869) |
| 106 | ALVQQGSAF | (SEQ ID NO: 870) |
| 80 | RYGDVFQIR | (SEQ ID NO: 871) |
| 55 | FAWPLIGNA | (SEQ ID NO: 872) |
| 54 | PFAWPLIGN | (SEQ ID NO: 873) |
| 6 | SPNDPWPLN | (SEQ ID NO: 874) |
| 529 | LDSAVQNLQ | (SEQ ID NO: 875) |
| 524 | ESMELLDSA | (SEQ ID NO: 876) |
| 511 | IKPKSFKVN | (SEQ ID NO: 877) |
| 507 | YGLTIKPKS | (SEQ ID NO: 878) |
| 494 | RANPNEPAK | (SEQ ID NO: 879) |
| 488 | AHQCDFRAN | (SEQ ID NO: 880) |
| 484 | ISILAHQCD | (SEQ ID NO: 881) |
| 62 | NAAAVGQAA | (SEQ ID NO: 882) |
| 58 | PLIGNAAAV | (SEQ ID NO: 883) |
| 56 | AWPLIGNAA | (SEQ ID NO: 884) |
| 32 | TVHVGQRLL | (SEQ ID NO: 885) |
| 24 | LLLLSVLAT | (SEQ ID NO: 886) |
| 530 | DSAVQNLQA | (SEQ ID NO: 887) |
| 503 | MNFSYGLTI | (SEQ ID NO: 888) |
| 463 | FSVGKRRCI | (SEQ ID NO: 889) |
| 412 | YHIPKDTVV | (SEQ ID NO: 890) |
| 411 | GYHIPKDTV | (SEQ ID NO: 891) |
| 406 | NTSVLGYHI | (SEQ ID NO: 892) |
| 387 | EAMRFSSFV | (SEQ ID NO: 893) |
| 350 | PDVQTRVQA | (SEQ ID NO: 894) |
| 339 | LQWLLLLFT | (SEQ ID NO: 895) |
| 315 | LDLENVPAT | (SEQ ID NO: 896) |
| 289 | PRDMMDAFI | (SEQ ID NO: 897) |
| 280 | CESLRPGAA | (SEQ ID NO: 898) |
| 264 | LNRNFSNFI | (SEQ ID NO: 899) |
| 253 | PVRTVFREF | (SEQ ID NO: 900) |
| 248 | QYFPNPVRT | (SEQ ID NO: 901) |
| 170 | VLSEARELV | (SEQ ID NO: 902) |
| 118 | PAFASFRVV | (SEQ ID NO: 903) |
| 100 | ERAIHQALV | (SEQ ID NO: 904) |
| 88 | RLGSCPIVV | (SEQ ID NO: 905) |
| 86 | QLRLGSCPI | (SEQ ID NO: 906) |
| 67 | GQAAHLSFA | (SEQ ID NO: 907) |
| 66 | VGQAAHLSF | (SEQ ID NO: 908) |
| 61 | GNAAAVGQA | (SEQ ID NO: 909) |
| 27 | LSVLATVHV | (SEQ ID NO: 910) |
| 524 | ESMELLDSA | (SEQ ID NO: 911) |
| 457 | TSRVMIFSV | (SEQ ID NO: 912) |
| 452 | INKDLTSRV | (SEQ ID NO: 913) |
| 435 | PNPENFDPA | (SEQ ID NO: 914) |
| 397 | VTIPHATTA | (SEQ ID NO: 915) |
| 386 | YEAMRFSSF | (SEQ ID NO: 916) |
| 383 | AFLYEAMRF | (SEQ ID NO: 917) |
| 373 | GDQPNLPYV | (SEQ ID NO: 918) |
| 356 | VQAELDQVV | (SEQ ID NO: 919) |
| 355 | RVQAELDQV | (SEQ ID NO: 920) |
| 348 | RYPDVQTRV | (SEQ ID NO: 921) |
| 330 | ASQDTLSTA | (SEQ ID NO: 922) |
| 326 | DIFGASQDT | (SEQ ID NO: 923) |
| 322 | ATLTDLFGA | (SEQ ID NO: 924) |
| 319 | NVPATLTDI | (SEQ ID NO: 925) |
| 312 | GARLDLENV | (SEQ ID NO: 926) |
| 287 | AAPRDMMDA | (SEQ ID NO: 927) |
| 279 | HCESLRPGA | (SEQ ID NO: 928) |
| 242 | DVMPWLQYF | (SEQ ID NO: 929) |
| 199 | VAVANVMSA | (SEQ ID NO: 930) |
| 196 | LTVVAVANV | (SEQ ID NO: 931) |
| 182 | VRGSADGAF | (SEQ ID NO: 932) |
| 149 | HSMMRNFFT | (SEQ ID NO: 933) |
| 147 | AAHSMMRNF | (SEQ ID NO: 934) |
| 140 | HWKVQRRAA | (SEQ ID NO: 935) |
| 139 | EHWKVQRRA | (SEQ ID NO: 936) |
| 111 | GSAFADRPA | (SEQ ID NO: 937) |
| 107 | LVQQGSAFA | (SEQ ID NO: 938) |
| 94 | IVVLNGERA | (SEQ ID NO: 939) |
| 76 | RLARRYGDV | (SEQ ID NO: 940) |
| 377 | NLPYVLAFL | (SEQ ID NO: 941) |
| 374 | DQPNLPYVL | (SEQ ID NO: 942) |
| 372 | MGDQPNLPY | (SEQ ID NO: 943) |
| 367 | DRLPCMGDQ | (SEQ ID NO: 944) |
| 309 | HGGGARLDL | (SEQ ID NO: 945) |
| 263 | QLNRNFSNF | (SEQ ID NO: 946) |
| 239 | SLVDVMPWL | (SEQ ID NO: 947) |
| 216 | HDDPEFREL | (SEQ ID NO: 948) |
| 212 | CRYSHDDPE | (SEQ ID NO: 949) |
| 197 | TVVAVANVM | (SEQ ID NO: 950) |
| 193 | PRPLTVVAV | (SEQ ID NO: 951) |

-continued

| | | |
|---|---|---|
| 172 | SEARELVAL | (SEQ ID NO: 952) |
| 160 | PRSRQVLEG | (SEQ ID NO: 953) |
| 157 | TRQPRSRQV | (SEQ ID NO: 954) |
| 147 | AAHSMMRNF | (SEQ ID NO: 955) |
| 137 | YSEHWKVQR | (SEQ ID NO: 956) |
| 100 | ERAIHQALV | (SEQ ID NO: 957) |
| 51 | PPGPFAWPL | (SEQ ID NO: 958) |
| 39 | LLRQRRRQL | (SEQ ID NO: 959) |
| 35 | VGQRLLRQR | (SEQ ID NO: 960) |
| 26 | LLSVLATVH | (SEQ ID NO: 961) |
| 19 | QQTTLLLLL | (SEQ ID NO: 962) |
| 18 | IQQTTLLLL | (SEQ ID NO: 963) |
| 17 | SIQQTTLLL | (SEQ ID NO: 964) |
| 8 | NDPWPLNPL | (SEQ ID NO: 965) |
| 521 | TLRESMELL | (SEQ ID NO: 966) |
| 499 | EPAKMNFSY | (SEQ ID NO: 967) |
| 493 | FRANPNEPA | (SEQ ID NO: 968) |
| 455 | DLTSRVMIF | (SEQ ID NO: 969) |
| 454 | KDLTSRVMI | (SEQ ID NO: 970) |
| 436 | NPENFDPAR | (SEQ ID NO: 971) |
| 393 | SFVPVTIPH | (SEQ ID NO: 972) |
| 386 | YEAMRFSSF | (SEQ ID NO: 973) |
| 378 | LPYVLAFLY | (SEQ ID NO: 974) |
| 336 | STALQWLLL | (SEQ ID NO: 975) |
| 284 | RPGAAPRDM | (SEQ ID NO: 976) |
| 259 | REFEQLNRN | (SEQ ID NO: 977) |
| 253 | PVRTVFREF | (SEQ ID NO: 978) |
| 242 | DVMPWLQYF | (SEQ ID NO: 979) |
| 241 | VDVMPWLQY | (SEQ ID NO: 980) |
| 186 | ADGAFLDPR | (SEQ ID NO: 981) |
| 167 | EGHVLSEAR | (SEQ ID NO: 982) |
| 148 | AHSMMRNFF | (SEQ ID NO: 983) |
| 141 | WKVQRRAAH | (SEQ ID NO: 984) |
| 128 | GGRSMAFGH | (SEQ ID NO: 985) |
| 122 | SFRVVSGGR | (SEQ ID NO: 986) |
| 96 | VLNGERAIH | (SEQ ID NO: 987) |
| 73 | SFARLARRY | (SEQ ID NO: 988) |
| 68 | QAAHLSFAR | (SEQ ID NO: 989) |
| 66 | VGQAAHLSF | (SEQ ID NO: 990) |
| 42 | QRRRQLRSA | (SEQ ID NO: 991) |
| 30 | LATVHVGQR | (SEQ ID NO: 992) |
| 522 | LRESMELLD | (SEQ ID NO: 993) |
| 518 | VNVTLRESM | (SEQ ID NO: 994) |
| 503 | MNFSYGLTI | (SEQ ID NO: 995) |
| 486 | ILAHQCDFR | (SEQ ID NO: 996) |
| 478 | MQLFLFISI | (SEQ ID NO: 997) |
| 475 | LSKMQLFLF | (SEQ ID NO: 998) |
| 453 | NKDLTSRVM | (SEQ ID NO: 999) |
| 243 | VMPWLQYFP | (SEQ ID NO: 1000) |
| 223 | ELLSHNEEF | (SEQ ID NO: 1001) |
| 189 | AFLDPRPLT | (SEQ ID NO: 1002) |
| 163 | RQVLEGHVL | (SEQ ID NO: 1003) |
| 117 | RPAFASFRV | (SEQ ID NO: 1004) |
| 113 | AFADRPAFA | (SEQ ID NO: 1005) |
| 100 | ERAIHQALV | (SEQ ID NO: 1006) |
| 71 | HLSFARLAR | (SEQ ID NO: 1007) |
| 67 | GQAAHLSFA | (SEQ ID NO: 1008) |
| 62 | NAAAVGQAA | (SEQ ID NO: 1009) |
| 61 | GNAAAVGQA | (SEQ ID NO: 1010) |
| 57 | WPLIGNAAA | (SEQ ID NO: 1011) |
| 49 | SAPPGPFAW | (SEQ ID NO: 1012) |
| 12 | PLNPLSIQQ | (SEQ ID NO: 1013) |
| 495 | ANPNEPAKM | (SEQ ID NO: 1014) |
| 487 | LAHQCDFRA | (SEQ ID NO: 1015) |
| 482 | LFLSLLAHQ | (SEQ ID NO: 1016) |
| 472 | GEELSKMQL | (SEQ ID NO: 1017) |
| 448 | KDGLINKDL | (SEQ ID NO: 1018) |
| 438 | ENFDPARFL | (SEQ ID NO: 1019) |
| 431 | PLKWPNPEN | (SEQ ID NO: 1020) |
| 426 | SVNHDPLKW | (SEQ ID NO: 1021) |
| 424 | QWSVNHDPL | (SEQ ID NO: 1022) |
| 399 | IPHATTANT | (SEQ ID NO: 1023) |
| 390 | RFSSFVPVT | (SEQ ID NO: 1024) |
| 382 | LAFLYEAMR | (SEQ ID NO: 1025) |
| 371 | CMGDQPNLP | (SEQ ID NO: 1026) |
| 368 | RLPCMGDQP | (SEQ ID NO: 1027) |
| 298 | LSAEKKAAG | (SEQ ID NO: 1028) |
| 287 | MPRDMMDA | (SEQ ID NO: 1029) |
| 265 | NRNFSNFIL | (SEQ ID NO: 1030) |
| 242 | DVMPWLQYF | (SEQ ID NO: 1031) |
| 204 | VMSAVCFGC | (SEQ ID NO: 1032) |
| 192 | DPRPLTVVA | (SEQ ID NO: 1033) |
| 158 | RQPRSRQVL | (SEQ ID NO: 1034) |
| 94 | IVVLNGERA | (SEQ ID NO: 1035) |
| 51 | PPGPFAWPL | (SEQ ID NO: 1036) |
| 48 | RSAPPGPFA | (SEQ ID NO: 1037) |
| 42 | QRRRQLRSA | (SEQ ID NO: 1038) |
| 13 | LNPLSIQQT | (SEQ ID NO: 1039) |
| 509 | LTIKPKSFK | (SEQ ID NO: 1040) |
| 505 | FSYGLTIKP | (SEQ ID NO: 1041) |
| 494 | RANPNEPAK | (SEQ ID NO: 1042) |
| 459 | RVMIFSVGK | (SEQ ID NO: 1043) |
| 447 | DKDGLINKD | (SEQ ID NO: 1044) |
| 417 | DTVVFVNQW | (SEQ ID NO: 1045) |
| 396 | PVTIPHATT | (SEQ ID NO: 1046) |
| 388 | AMRFSSFVP | (SEQ ID NO: 1047) |
| 347 | TRYPDVQTR | (SEQ ID NO: 1048) |
| 340 | QWLLLLFTR | (SEQ ID NO: 1049) |
| 323 | TLTDLFGAS | (SEQ ID NO: 1050) |
| 299 | SAEKKAAGD | (SEQ ID NO: 1051) |
| 294 | DAFILSAE-K | (SEQ ID NO: 1052) |
| 291 | DMMDAFILS | (SEQ ID NO: 1053) |
| 286 | GAAPRDMMD | (SEQ ID NO: 1054) |
| 248 | QYFPNPVRT | (SEQ ID NO: 1055) |
| 229 | EEFGRTVGA | (SEQ ID NO: 1056) |
| 226 | SHNEEFGRT | (SEQ ID NO: 1057) |
| 203 | NVMSAVCFG | (SEQ ID NO: 1058) |
| 1468 | RRCIGEELS | (SEQ ID NO: 1059) |
| 460 | VMIFSVGKR | (SEQ ID NO: 1060) |
| 457 | TSRVMIFSV | (SEQ ID NO: 1061) |
| 432 | LKWPNPENF | (SEQ ID NO: 1062) |
| I420 | VFVNQWSVN | (SEQ ID NO: 1063) |
| 1409 | VLGYHIPKD | (SEQ ID NO: 1064) |
| 373 | GDQPNLPYV | (SEQ ID NO: 1065) |
| 371 | CMGDQPNLP | (SEQ ID NO: 1066) |
| 367 | DRLPCMGDQ | (SEQ ID NO: 1067) |
| 358 | AELDQVVGR | (SEQ ID NO: 1068) |
| 321 | PATLTDLFG | (SEQ ID NO: 1069) |
| 298 | LSAEKKAAG | (SEQ ID NO: 1070) |
| 276 | FLRHCESLR | (SEQ ID NO: 1071) |
| 263 | QLNRNFSNF | (SEQ ID NO: 1072) |
| 249 | YFPNPVRTV | (SEQ ID NO: 1073) |
| 248 | QYFPNPVRT | (SEQ ID NO: 1074) |
| 245 | PWLQYFPNP | (SEQ ID NO: 1075) |
| 242 | DVMPWLQYF | (SEQ ID NO: 1076) |
| 237 | AGSLVDVMP | (SEQ ID NO: 1077) |
| 231 | FGRTVGAGS | (SEQ ID NO: 1078) |
| 225 | LSHNEEFGR | (SEQ ID NO: 1079) |
| 194 | RPLTVVAVA | (SEQ ID NO: 1080) |
| 178 | VALLVRGSA | (SEQ ID NO: 1081) |
| 164 | QVLEGHVLS | (SEQ ID NO: 1082) |
| 157 | TRQPRSRQV | (SEQ ID NO: 1083) |
| 131 | SMAFGHYSE | (SEQ ID NO: 1084) |
| 122 | SFRVVSGGR | (SEQ ID NO: 1085) |
| 118 | PAFASFRVV | (SEQ ID NO: 1086) |
| 111 | GSAFADRPA | (SEQ ID NO: 1087) |
| 97 | LNGERAIHQ | (SEQ ID NO: 1088) |
| 96 | VLNGERAITi | (SEQ ID NO: 1089) |
| 82 | GDVFQIRLG | (SEQ ID NO: 1090) |
| 72 | LSFARLARR | (SEQ ID NO: 1091) |
| 69 | AAHLSFARL | (SEQ ID NO: 1092) |
| 64 | AAVGQAAHL | (SEQ ID NO: 1093) |
| 51 | PPGPFAWPL | (SEQ ID NO: 1094) |
| 38 | RLLRQRRRQ | (SEQ ID NO: 1095) |
| 32 | TVHVGQRLL | (SEQ ID NO: 1096) |
| 29 | VLATVHVGQ | (SEQ ID NO: 1097) |
| 28 | SVLATVHVG | (SEQ ID NO: 1098) |
| 27 | LSVLATVHV | (SEQ ID NO: 1099) |
| 5 | LSPNDPWPL | (SEQ ID NO: 1100) |
| 533 | VQNLQAKET | (SEQ ID NO: 1101) |
| 532 | AVQNLQAKE | (SEQ ID NO: 1102) |
| 521 | TLRESMELL | (SEQ ID NO: 1103) |
| 500 | PAKMNFSYG | (SEQ ID NO: 1104) |
| 495 | ANPNEPAKM | (SEQ ID NO: 1105) |
| 493 | FRANPNEPA | (SEQ ID NO: 1106) |
| 486 | ILAHQCDFR | (SEQ ID NO: 1107) |
| 464 | SVGKRRCIG | (SEQ ID NO: 1108) |
| 461 | MIFSVGKRR | (SEQ ID NO: 1109) |

-continued

| | | |
|---|---|---|
| 435 | PNPENFDPA | (SEQ ID NO: 1110) |
| 431 | PLKWPNPEN | (SEQ ID NO: 1111) |
| 423 | NQWSVNHDP | (SEQ ID NO: 1112) |
| 418 | TVVFVNQWS | (SEQ ID NO: 1113) |
| 405 | ANTSVLGYH | (SEQ ID NO: 1114) |
| 389 | MRFSSFVPV | (SEQ ID NO: 1115) |
| 377 | NLPYVLAFL | (SEQ ID NO: 1116) |
| 375 | QPNLPYVLA | (SEQ ID NO: 1117) |
| 70 | AHLSFARLA | (SEQ ID NO: 1118) |
| 42 | QRRRQLRSA | (SEQ ID NO: 1119) |
| 23 | LLLLLSVLA | (SEQ ID NO: 1120) |
| 21 | TTLLLLLSV | (SEQ ID NO: 1121) |
| 10 | PWPLNPLSI | (SEQ ID NO: 1122) |
| 525 | SMELLDSAV | (SEQ ID NO: 1123) |
| 510 | TIKPKSFKV | (SEQ ID NO: 1124) |
| 502 | KMNFSYGLT | (SEQ ID NO: 1125) |
| 497 | PNEPAKMNF | (SEQ ID NO: 1126) |
| 485 | SILAHQCDF | (SEQ ID NO: 1127) |
| 478 | MQLFLFISI | (SEQ ID NO: 1128) |
| 473 | EELSKMQLF | (SEQ ID NO: 1129) |
| 455 | DLTSRVMIF | (SEQ ID NO: 1130) |
| 444 | RFLDKDGLI | (SEQ ID NO: 1131) |
| 437 | PENFDPARF | (SEQ ID NO: 1132) |
| 432 | LKWPNPENF | (SEQ ID NO: 1133) |
| 401 | HATTANTSV | (SEQ ID NO: 1134) |
| 394 | FVPVTIPHA | (SEQ ID NO: 1135) |
| 380 | YVLAFLYEA | (SEQ ID NO: 1136) |
| 372 | MGDQPNLPY | (SEQ ID NO: 1137) |
| 344 | LLFTRYPDV | (SEQ ID NO: 1138) |
| 316 | DLENVPATI | (SEQ ID NO: 1139) |
| 281 | ESLRPGAAP | (SEQ ID NO: 1140) |
| 263 | QLNRNFSNF | (SEQ ID NO: 1141) |
| 260 | EFEQLNRNF | (SEQ ID NO: 1142) |
| 246 | WLQYFPNPV | (SEQ ID NO: 1143) |
| 227 | HNEEFGRTV | (SEQ ID NO: 1144) |
| 226 | SHNEEFGRT | (SEQ ID NO: 1145) |
| 223 | ELLSHNEEF | (SEQ ID NO: 1146) |
| 178 | VALLVRGSA | (SEQ ID NO: 1147) |
| 166 | LEGHVLSEA | (SEQ ID NO: 1148) |
| 157 | TRQPRSRQV | (SEQ ID NO: 1149) |
| 119 | AFASFRVVS | (SEQ ID NO: 1150) |
| 95 | VVLNGERAI | (SEQ ID NO: 1151) |
| 78 | ARRYGDVFQ | (SEQ ID NO: 1152) |
| 55 | FAWPLIGNA | (SEQ ID NO: 1153) |
| 52 | PGPFAWPLI | (SEQ ID NO: 1154) |
| 25 | LLLSVLATV | (SEQ ID NO: 1155) |
| 533 | VQNLQAKET | (SEQ ID NO: 1156) |
| 508 | GLTIKPKSF | (SEQ ID NO: 1157) |
| 487 | LAHQCDFRA | (SEQ ID NO: 1158) |
| 480 | LFLFLSLLA | (SEQ ID NO: 1159) |
| 475 | LSKMQLFLF | (SEQ ID NO: 1160) |
| 449 | DGLINKDLT | (SEQ ID NO: 1161) |
| 419 | VVFVNQWSV | (SEQ ID NO: 1162) |
| 410 | LGYHIPKDT | (SEQ ID NO: 1163) |
| 366 | RDRLPCMGD | (SEQ ID NO: 1164) |
| 296 | FILSAEKKA | (SEQ ID NO: 1165) |
| 285 | PGAAPRDMM | (SEQ ID NO: 1166) |
| 268 | FSNFILDKF | (SEQ ID NO: 1167) |
| 237 | AGSLVDVMP | (SEQ ID NO: 1168) |
| 185 | SADGAFLDP | (SEQ ID NO: 1169) |
| 162 | SRQVLEGHV | (SEQ ID NO: 1170) |
| 156 | FTRQPRSRQ | (SEQ ID NO: 1171) |
| 135 | GHYSEHWKV | (SEQ ID NO: 1172) |
| 105 | QALVQQGSA | (SEQ ID NO: 1173) |
| 98 | NGERAIHQA | (SEQ ID NO: 1174) |
| 71 | HLSFARLAR | (SEQ ID NO: 1175) |
| 13 | LNPLSIQQT | (SEQ ID NO: 1176) |
| 440 | FDPARFLDK | (SEQ ID NO: 1177) |
| 405 | ANTSVLGYH | (SEQ ID NO: 1178) |
| 404 | TANTSVLGY | (SEQ ID NO: 1179) |
| 360 | LDQVVGRDR | (SEQ ID NO: 1180) |
| 348 | RYPDVQTRV | (SEQ ID NO: 1181) |
| 334 | TLSTALQWL | (SEQ ID NO: 1182) |
| 320 | VPATLTDLF | (SEQ ID NO: 1183) |
| 319 | NVPATLTDI | (SEQ ID NO: 1184) |
| 288 | APRDMMDAF | (SEQ ID NO: 1185) |
| 276 | FLRHCESLR | (SEQ ID NO: 1186) |
| 251 | PNPVRTVFR | (SEQ ID NO: 1187) |
| 225 | LSHNEEFGR | (SEQ ID NO: 1188) |

-continued

| | | |
|---|---|---|
| 217 | DDPEFRELL | (SEQ ID NO: 1189) |
| 206 | SAVCFGCRY | (SEQ ID NO: 1190) |
| 162 | SRQVLEGHV | (SEQ ID NO: 1191) |
| 155 | FFTRQPRSR | (SEQ ID NO: 1192) |
| 152 | MRNFFTRQP | (SEQ ID NO: 1193) |
| 150 | SMMRNFFTR | (SEQ ID NO: 1194) |
| 134 | FGHYSEHWK | (SEQ ID NO: 1195) |
| 109 | QQGSAFADR | (SEQ ID NO: 1196) |
| 77 | LARRYGDVF | (SEQ ID NO: 1197) |
| 71 | HLSFARLAR | (SEQ ID NO: 1198) |
| 5 | LSPNDPWPL | (SEQ ID NO: 1199) |
| 476 | SKMQLFLFI | (SEQ ID NO: 1200) |
| 463 | FSVGKRRCI | (SEQ ID NO: 1201) |
| 424 | QWSVNHDPL | (SEQ ID NO: 1202) |
| 364 | VGRDRLPCM | (SEQ ID NO: 1203) |
| 254 | VRTVFREFE | (SEQ ID NO: 1204) |
| 222 | RELLSHNEE | (SEQ ID NO: 1205) |
| 214 | YSHDDPEFR | (SEQ ID NO: 1206) |
| 205 | MSAVCFGCR | (SEQ ID NO: 1207) |
| 194 | RPLTVVAVA | (SEQ ID NO: 1208) |
| 143 | VQRRAAHSM | (SEQ ID NO: 1209) |
| 95 | VVLNGERAI | (SEQ ID NO: 1210) |
| 86 | QLRGSCPI | (SEQ ID NO: 1211) |
| 450 | GLINKDLTS | (SEQ ID NO: 1212) |
| 447 | DKDGLINKD | (SEQ ID NO: 1213) |
| 391 | FSSFVPVTI | (SEQ ID NO: 1214) |
| 381 | VLAFLYEAM | (SEQ ID NO: 1215) |
| 316 | DLENVPATI | (SEQ ID NO: 1216) |
| 301 | EKKAAGDSH | (SEQ ID NO: 1217) |
| 285 | PGAAPRDMM | (SEQ ID NO: 1218) |
| 168 | GHVLSEARE | (SEQ ID NO: 1219) |
| 135 | GHYSEHWKV | (SEQ ID NO: 1220) |
| 101 | RAIHQALVQ | (SEQ ID NO: 1221) |
| 45 | RQLRSAPPG | (SEQ ID NO: 1222) |
| 41 | RQRRRQLRS | (SEQ ID NO: 1223) |
| 10 | PWPLNPLSI | (SEQ ID NO: 1224) |
| 505 | FSYGLTIKP | (SEQ ID NO: 1225) |
| 412 | YHLPKDTVV | (SEQ ID NO: 1226) |
| 406 | NTSVLGYHI | (SEQ ID NO: 1227) |
| 314 | RLDLENVPA | (SEQ ID NO: 1228) |
| 266 | RNFSNFILD | (SEQ ID NO: 1229) |
| 264 | LNRNFSNFI | (SEQ ID NO: 1230) |
| 233 | RTVGAGSLV | (SEQ ID NO: 1231) |
| 154 | NFFTRQPRS | (SEQ ID NO: 1232) |
| 146 | RAAHSMMRN | (SEQ ID NO: 1233) |
| 38 | RLLRQRRRQ | (SEQ ID NO: 1234) |
| 532 | AVQNLQAKE | (SEQ ID NO: 1235) |
| 198 | VVAVANVMS | (SEQ ID NO: 1236) |
| 197 | TVVAVANVM | (SEQ ID NO: 1237) |
| 195 | PLTVVAVAN | (SEQ ID NO: 1238) |
| 185 | SADGAFLDP | (SEQ ID NO: 1239) |
| 151 | MMRNFFTRQ | (SEQ ID NO: 1240) |
| 132 | MAFGHYSEH | (SEQ ID NO: 1241) |
| 112 | SAFADRPAF | (SEQ ID NO: 1242) |
| 90 | GSCPIVVLN | (SEQ ID NO: 1243) |
| 72 | LSFARLARR | (SEQ ID NO: 1244) |
| 70 | AHLSFARLA | (SEQ ID NO: 1245) |
| 34 | HVGQRLLRQ | (SEQ ID NO: 1246) |
| 30 | LATVHVGQR | (SEQ ID NO: 1247) |
| 20 | QTTLLLLLS | (SEQ ID NO: 1248) |
| 518 | VNVTLRESM | (SEQ ID NO: 1249) |
| 493 | FRANPNEPA | (SEQ ID NO: 1250) |
| 461 | MIFSVGKRR | (SEQ ID NO: 1251) |
| 446 | LDKDGLINK | (SEQ ID NO: 1252) |
| 441 | DPARFLDKD | (SEQ ID NO: 1253) |
| 421 | FVNQWSVNH | (SEQ ID NO: 1254) |
| 403 | TTANTSVLG | (SEQ ID NO: 1255) |
| 392 | SSFVPVTLP | (SEQ ID NO: 1256) |
| 376 | PNLPYVLAF | (SEQ ID NO: 1257) |
| 375 | QPNLPYVLA | (SEQ ID NO: 1258) |
| 351 | DVQTRVQAE | (SEQ ID NO: 1259) |
| 317 | LENVPATIT | (SEQ ID NO: 1260) |
| 304 | AAGDSHGGG | (SEQ ID NO: 1261) |
| 259 | REFEQLNRN | (SEQ ID NO: 1262) |
| 201 | VANVMSAVC | (SEQ ID NO: 1263) |
| 143 | VQRRAAHSM | (SEQ ID NO: 1264) |
| 121 | ASFRVVSGG | (SEQ ID NO: 1265) |
| 115 | ADRPAFASF | (SEQ ID NO: 1266) |
| 98 | NGERAIHQA | (SEQ ID NO: 1267) |

-continued

| | | |
|---|---|---|
| 93 | PIVVLNGER | (SEQ ID NO: 1268) |
| 92 | CPIVVLNGE | (SEQ ID NO: 1269) |
| 68 | QAAHLSFAR | (SEQ ID NO: 1270) |
| 56 | AWPLIGNAA | (SEQ ID NO: 1271) |
| 14 | NPLSIQQTT | (SEQ ID NO: 1272) |
| 10 | PWPLNPLSI | (SEQ ID NO: 1273) |
| 533 | VQNLQAKET | (SEQ ID NO: 1274) |
| 507 | YGLTIKPKS | (SEQ ID NO: 1275) |
| 480 | LFLFLSLLA | (SEQ ID NO: 1276) |
| 469 | RCIGEELSK | (SEQ ID NO: 1277) |
| 466 | GKRRCIGEE | (SEQ ID NO: 1278) |
| 395 | VPVTIPHAT | (SEQ ID NO: 1279) |
| 313 | ARLDLENVP | (SEQ ID NO: 1280) |
| 311 | GGARLDLEN | (SEQ ID NO: 1281) |
| 305 | AGDSHGGGA | (SEQ ID NO: 1282) |
| 289 | PRDMMDAFI | (SEQ ID NO: 1283) |
| 268 | FSNFILDKF | (SEQ ID NO: 1284) |
| 238 | GSLVDVMPW | (SEQ ID NO: 1285) |
| 234 | TVGAGSLVD | (SEQ ID NO: 1286) |
| 208 | VCFGCRYSH | (SEQ ID NO: 1287) |
| 207 | AVCFGCRYS | (SEQ ID NO: 1288) |
| 206 | SAVCFGCRY | (SEQ ID NO: 1289) |
| 186 | ADGAFLDPR | (SEQ ID NO: 1290) |
| 175 | RELVALLVR | (SEQ ID NO: 1291) |
| 142 | KVQRRAAHS | (SEQ ID NO: 1292) |
| 138 | SEHWKVQRR | (SEQ ID NO: 1293) |
| 119 | AFASFRVVS | (SEQ ID NO: 1294) |
| 362 | QVVGRDRLP | (SEQ ID NO: 1295) |
| 361 | DQVVGRDRL | (SEQ ID NO: 1296) |
| 360 | LDQVVGRDR | (SEQ ID NO: 1297) |
| 352 | VQTRVQAEL | (SEQ ID NO: 1298) |
| 323 | TITDIFGAS | (SEQ ID NO: 1299) |
| 306 | GDSHGGGAR | (SEQ ID NO: 1300) |
| 296 | FILSAEKKA | (SEQ ID NO: 1301) |
| 295 | AFILSAEKK | (SEQ ID NO: 1302) |
| 285 | PGAAPRDMM | (SEQ ID NO: 1303) |
| 257 | VFREFEQLN | (SEQ ID NO: 1304) |
| 256 | TVFREFEQL | (SEQ ID NO: 1305) |
| 247 | LQYFPNPVR | (SEQ ID NO: 1306) |
| 217 | DDPEFRELL | (SEQ ID NO: 1307) |
| 208 | VCFGCRYSH | (SEQ ID NO: 1308) |
| 207 | AVCFGCRYS | (SEQ ID NO: 1309) |
| 204 | VMSAVCFGC | (SEQ ID NO: 1310) |
| 200 | AVANVMSAV | (SEQ ID NO: 1311) |
| 198 | VVAVANVMS | (SEQ ID NO: 1312) |
| 197 | TVVAVANVM | (SEQ ID NO: 1313) |
| 195 | PLTVVAVAN | (SEQ ID NO: 1314) |
| 180 | LLVRGSADG | (SEQ ID NO: 1315) |
| 179 | ALLVRGSAD | (SEQ ID NO: 1316) |
| 173 | EARELVALL | (SEQ ID NO: 1317) |
| 155 | FFTRQPRSR | (SEQ ID NO: 1318) |
| 151 | MMRNFFTRQ | (SEQ ID NO: 1319) |
| 140 | HWKVQRRAA | (SEQ ID NO: 1320) |
| 138 | SEHWKVC2RR | (SEQ ID NO: 1321) |
| 124 | RVVSGGRSM | (SEQ ID NO: 1322) |
| 119 | AFASFRVVS | (SEQ ID NO: 1323) |
| 112 | SAFADRPAF | (SEQ ID NO: 1324) |
| 109 | QQGSAFADR | (SEQ ID NO: 1325) |
| 95 | VVLNGERAI | (SEQ ID NO: 1326) |
| 78 | ARRYGDVFQ | (SEQ ID NO: 1327) |
| 77 | LARRYGDVF | (SEQ ID NO: 1328) |
| 70 | AHLSFARLA | (SEQ ID NO: 1329) |
| 65 | AVGQAAHLS | (SEQ ID NO: 1330) |
| 63 | AAAVGQAAH | (SEQ ID NO: 1331) |
| 62 | NAAAVGQAA | (SEQ ID NO: 1332) |
| 57 | WPLIGNAAA | (SEQ ID NO: 1333) |
| 40 | LRQRRRQLR | (SEQ ID NO: 1334) |
| 25 | LLLSVLATV | (SEQ ID NO: 1335) |
| 23 | LLLLLSVLA | (SEQ ID NO: 1336) |
| 15 | PLSIQQTTL | (SEQ ID NO: 1337) |
| 531 | SAVQNLQAK | (SEQ ID NO: 1338) |
| 518 | VNVTLRESM | (SEQ ID NO: 1339) |
| 513 | PKSFKVNVT | (SEQ ID NO: 1340) |
| 506 | SYGLTIKPK | (SEQ ID NO: 1341) |
| 504 | NFSYGLTIK | (SEQ ID NO: 1342) |
| 502 | KMNFSYGLT | (SEQ ID NO: 1343) |
| 496 | NPNEPAKMN | (SEQ ID NO: 1344) |
| 485 | SILAHQCDF | (SEQ ID NO: 1345) |
| 473 | EELSKMQLF | (SEQ ID NO: 1346) |
| 470 | CIGEELSKM | (SEQ ID NO: 1347) |
| 462 | IFSVGKRRC | (SEQ ID NO: 1348) |
| 455 | DLTSRVMIF | (SEQ ID NO: 1349) |
| 454 | KDLTSRVMI | (SEQ ID NO: 1350) |
| 449 | DGLINKDLT | (SEQ ID NO: 1351) |
| 444 | RFLDKDGLI | (SEQ ID NO: 1352) |
| 441 | DPARFLDKD | (SEQ ID NO: 1353) |
| 523 | RESMELLDS | (SEQ ID NO: 1354) |
| 509 | LTIKPKSFK | (SEQ ID NO: 1355) |
| 469 | RCIGEELSK | (SEQ ID NO: 1356) |
| 445 | FLDKDGLIN | (SEQ ID NO: 1357) |
| 433 | KWPNPENFD | (SEQ ID NO: 1358) |
| 392 | SSFVPVTIP | (SEQ ID NO: 1359) |
| 388 | AMRFSSFVP | (SEQ ID NO: 1360) |
| 363 | VVGRDRLPC | (SEQ ID NO: 1361) |
| 358 | AELDQVVGR | (SEQ ID NO: 1362) |
| 282 | SLRPGAAPR | (SEQ ID NO: 1363) |
| 247 | LQYFPNPVR | (SEQ ID NO: 1364) |
| 241 | VDVMPWLQY | (SEQ ID NO: 1365) |
| 234 | TVGAGSLVD | (SEQ ID NO: 1366) |
| 186 | ADGAFLDPR | (SEQ ID NO: 1367) |
| 165 | VLEGHVLSE | (SEQ ID NO: 1368) |
| 160 | PRSRQVLEG | (SEQ ID NO: 1369) |
| 120 | FASFRVVSG | (SEQ ID NO: 1370) |
| 114 | FADRPAFAS | (SEQ ID NO: 1371) |
| 63 | AAAVGQAAH | (SEQ ID NO: 1372) |
| 43 | RRRQLRSAP | (SEQ ID NO: 1373) |
| 41 | RQRRRQLRS | (SEQ ID NO: 1374) |
| 33 | VHVGQRLLR | (SEQ ID NO: 1375) |
| 511 | IKPKSFKVN | (SEQ ID NO: 1376) |
| 494 | RANPNEPAK | (SEQ ID NO: 1377) |
| 488 | AHQCDFRAN | (SEQ ID NO: 1378) |
| 459 | RVMIFSVGK | (SEQ ID NO: 1379) |
| 440 | FDPARFLDK | (SEQ ID NO: 1380) |
| 431 | PLKWPNPEN | (SEQ ID NO: 1381) |
| 416 | KDTVVFVNQ | (SEQ ID NO: 1382) |
| 324 | ITDIFGASQ | (SEQ ID NO: 1383) |
| 306 | GDSHGGGAR | (SEQ ID NO: 1384) |
| 303 | KAAGDSHGG | (SEQ ID NO: 1385) |
| 267 | NFSNFILDK | (SEQ ID NO: 1386) |
| 251 | PNPVRTVFR | (SEQ ID NO: 1387) |
| 231 | FGRTVGAGS | (SEQ ID NO: 1388) |
| 230 | EFGRTVGAG | (SEQ ID NO: 1389) |
| 215 | SHDDPEFRE | (SEQ ID NO: 1390) |
| 179 | ALLVRGSAD | (SEQ ID NO: 1391) |
| 176 | ELVALLVRG | (SEQ ID NO: 1392) |
| 175 | RELVALLVR | (SEQ ID NO: 1393) |
| 151 | MMRNFFTRQ | (SEQ ID NO: 1394) |
| 130 | RSMAFGHYS | (SEQ ID NO: 1395) |
| 102 | AIHQALVQQ | (SEQ ID NO: 1396) |
| 101 | RAIHQALVQ | (SEQ ID NO: 1397) |
| 96 | VLNGERAIH | (SEQ ID NO: 1398) |
| 90 | GSCPIVVLN | (SEQ ID NO: 1399) |
| 75 | ARLARRYGD | (SEQ ID NO: 1400) |
| 60 | IGNAAAVGQ | (SEQ ID NO: 1401) |
| 54 | PFAWPLIGN | (SEQ ID NO: 1402) |
| 26 | LLSVLATVH | (SEQ ID NO: 1403) |
| 7 | PNDPWPLNP | (SEQ ID NO: 1404) |
| 4 | SLSPNDPWP | (SEQ ID NO: 1405) |
| 3 | TSLSPNDPW | (SEQ ID NO: 1406) |
| 532 | AVQNLQAKE | (SEQ ID NO: 1407) |
| 529 | LDSAVQNLQ | (SEQ ID NO: 1408) |
| 527 | ELLDSAVQN | (SEQ ID NO: 1409) |
| 516 | FKVNVTLRE | (SEQ ID NO: 1410) |
| 505 | FSYGLTIKP | (SEQ ID NO: 1411) |
| 504 | NFSYGLTIK | (SEQ ID NO: 1412) |
| 523 | RESMELLDS | (SEQ ID NO: 1413) |
| 507 | YGLTIKPKS | (SEQ ID NO: 1414) |
| 491 | CDFRANPNE | (SEQ ID NO: 1415) |
| 466 | GKRRCIGEE | (SEQ ID NO: 1416) |
| 419 | VVFVNQWSV | (SEQ ID NO: 1417) |
| 397 | VTIPHATTA | (SEQ ID NO: 1418) |
| 392 | SSFVPVTIP | (SEQ ID NO: 1419) |
| 390 | RFSSFVPVT | (SEQ ID NO: 1420) |
| 366 | RDRLPCMGD | (SEQ ID NO: 1421) |
| 355 | RVQAELDQV | (SEQ ID NO: 1422) |
| 329 | GASQDTLST | (SEQ ID NO: 1423) |
| 325 | TDIFGASQD | (SEQ ID NO: 1424) |
| 312 | GARLDLENV | (SEQ ID NO: 1425) |

-continued

| | | |
|---|---|---|
| 311 | GGARLDLEN | (SEQ ID NO: 1426) |
| 278 | RHCESLRPG | (SEQ ID NO: 1427) |
| 248 | QYFPNPVRT | (SEQ ID NO: 1428) |
| 245 | PWLQYFPNP | (SEQ ID NO: 1429) |
| 238 | GSLVDVMPW | (SEQ ID NO: 1430) |
| 139 | EHWKVQRRA | (SEQ ID NO: 1431) |
| 121 | ASFRVVSGG | (SEQ ID NO: 1432) |
| 117 | RPAFASFRV | (SEQ ID NO: 1433) |
| 90 | GSCPIVVLN | (SEQ ID NO: 1434) |
| 83 | DVFQIRLGS | (SEQ ID NO: 1435) |
| 82 | GDVFQIRLG | (SEQ ID NO: 1436) |
| 55 | FAWPLIGNA | (SEQ ID NO: 1437) |
| 53 | GPFAWPLIG | (SEQ ID NO: 1438) |
| 52 | PGPFAWPLI | (SEQ ID NO: 1439) |
| 48 | RSAPPGPFA | (SEQ ID NO: 1440) |
| 21 | TTLLLLLSV | (SEQ ID NO: 1441) |
| 534 | QNLQAKETC | (SEQ ID NO: 1442) |
| 527 | ELLDSAVQN | (SEQ ID NO: 1443) |
| 526 | MELLDSAVQ | (SEQ ID NO: 1444) |
| 512 | KPKSFKVNV | (SEQ ID NO: 1445) |
| 462 | IFSVGKRRC | (SEQ ID NO: 1446) |
| 416 | KDTVVFVNQ | (SEQ ID NO: 1447) |
| 411 | GYHIPKDTV | (SEQ ID NO: 1448) |
| 409 | VLGYHIPKD | (SEQ ID NO: 1449) |
| 373 | GDQPNLPYV | (SEQ ID NO: 1450) |
| 359 | ELDQVVGRD | (SEQ ID NO: 1451) |
| 326 | DIFGASQDT | (SEQ ID NO: 1452) |
| 322 | ATITDIFGA | (SEQ ID NO: 1453) |
| 302 | KKAAGDSHG | (SEQ ID NO: 1454) |
| 286 | GAAPRDMMD | (SEQ ID NO: 1455) |
| 255 | RTVFREFEQ | (SEQ ID NO: 1456) |
| 229 | EEFGRTVGA | (SEQ ID NO: 1457) |
| 184 | GSADGAFLD | (SEQ ID NO: 1458) |
| 176 | ELVALLVRG | (SEQ ID NO: 1459) |
| 164 | QVLEGHVLS | (SEQ ID NO: 1460) |
| 156 | FTRQPRSRQ | (SEQ ID NO: 1461) |
| 107 | LVQQGSAFA | (SEQ ID NO: 1462) |
| 102 | AIHQALVQQ | (SEQ ID NO: 1463) |
| 88 | RLGSCPIVV | (SEQ ID NO: 1464) |
| 58 | PLIGNAAAV | (SEQ ID NO: 1465) |
| 57 | WPLIGNAAA | (SEQ ID NO: 1466) |
| 34 | HVGQRLLRQ | (SEQ ID NO: 1467) |
| 25 | LLLSVLATV | (SEQ ID NO: 1468) |
| 24 | LLLLSVLAT | (SEQ ID NO: 1469) |
| 23 | LLLLLSVLA | (SEQ ID NO: 1470) |
| 14 | NPLSIQQTT | (SEQ ID NO: 1471) |
| 114 | FADRPAFAS | (SEQ ID NO: 1472) |
| 103 | IHQALVQQG | (SEQ ID NO: 1473) |
| 101 | RAIHQALVQ | (SEQ ID NO: 1474) |
| 91 | SCPIVVLNG | (SEQ ID NO: 1475) |
| 84 | VFQIRLGSC | (SEQ ID NO: 1476) |
| 77 | LARRYGDVF | (SEQ ID NO: 1477) |
| 65 | AVGQAAHLS | (SEQ ID NO: 1478) |
| 50 | APPGPFAWP | (SEQ ID NO: 1479) |
| 11 | WPLNPLSIQ | (SEQ ID NO: 1480) |
| 530 | DSAVQNLQA | (SEQ ID NO: 1481) |
| 513 | PKSFKVNVT | (SEQ ID NO: 1482) |
| 464 | SVGKRRCIG | (SEQ ID NO: 1483) |
| 456 | LTSRVMIFS | (SEQ ID NO: 1484) |
| 427 | VNHDPLKWP | (SEQ ID NO: 1485) |
| 422 | VNQWSVNHD | (SEQ ID NO: 1486) |
| 410 | LGYHIPKDT | (SEQ ID NO: 1487) |
| 393 | SFVPVTIPH | (SEQ ID NO: 1488) |
| 386 | YEAMRFSSF | (SEQ ID NO: 1489) |
| 363 | VVGRDRLPC | (SEQ ID NO: 1490) |
| 362 | QVVGRDRLP | (SEQ ID NO: 1491) |
| 333 | DTLSTALQW | (SEQ ID NO: 1492) |
| 308 | SHGGGARLD | (SEQ ID NO: 1493) |
| 295 | AFILSAEKK | (SEQ ID NO: 1494) |
| 293 | MDAFILSAE | (SEQ ID NO: 1495) |
| 279 | HCESLRPGA | (SEQ ID NO: 1496) |
| 278 | RHCESLRPG | (SEQ ID NO: 1497) |
| 267 | NFSNFILDK | (SEQ ID NO: 1498) |
| 240 | LVDVMPWLQ | (SEQ ID NO: 1499) |
| 184 | GSADGAFLD | (SEQ ID NO: 1500) |
| 171 | LSEARELVA | (SEQ ID NO: 1501) |
| 156 | FTRQPRSRQ | (SEQ ID NO: 1502) |
| 147 | AAHSMMRNF | (SEQ ID NO: 1503) |
| 146 | RAAHSMMRN | (SEQ ID NO: 1504) |
| 111 | GSAFADRPA | (SEQ ID NO: 1505) |
| 83 | DVFQIRLGS | (SEQ ID NO: 1506) |
| 75 | ARLARRYGD | (SEQ ID NO: 1507) |
| 60 | IGNAAAVGQ | (SEQ ID NO: 1508) |
| 35 | VGQRLLRQR | (SEQ ID NO: 1509) |
| 6 | SPNDPWPLN | (SEQ ID NO: 1510) |
| 2 | GTSLSPNDP | (SEQ ID NO: 1511) |
| 523 | RESMELLDS | (SEQ ID NO: 1512) |
| 515 | SFKVNVTLR | (SEQ ID NO: 1513) |
| 506 | SYGLTIKPK | (SEQ ID NO: 1514) |
| 504 | NFSYGLTIK | (SEQ ID NO: 1515) |
| 475 | LSKMQLFLF | (SEQ ID NO: 1516) |
| 449 | DGLINKDLT | (SEQ ID NO: 1517) |
| 432 | LKWPNPENF | (SEQ ID NO: 1518) |
| 405 | ANTSVLGYH | (SEQ ID NO: 1519) |
| 357 | QAELDQVVG | (SEQ ID NO: 1520) |
| 320 | VPATLTDLF | (SEQ ID NO: 1521) |
| 310 | GGGARLDLE | (SEQ ID NO: 1522) |
| 302 | KKAAGDSHG | (SEQ ID NO: 1523) |
| 283 | LRPGAAPRD | (SEQ ID NO: 1524) |
| 280 | CESLRPGAA | (SEQ ID NO: 1525) |
| 255 | RTVFREFEQ | (SEQ ID NO: 1526) |
| 222 | RELLSHNEE | (SEQ ID NO: 1527) |
| 219 | PEFRELLSH | (SEQ ID NO: 1528) |
| 161 | RSRQVLEGH | (SEQ ID NO: 1529) |
| 149 | HSMMRNFFT | (SEQ ID NO: 1530) |
| 427 | VNHDPLKWP | (SEQ ID NO: 1531) |
| 422 | VNQWSVNHD | (SEQ ID NO: 1532) |
| 390 | RFSSFVPVT | (SEQ ID NO: 1533) |
| 388 | AMRFSSFVP | (SEQ ID NO: 1534) |
| 384 | FLYEAMRFS | (SEQ ID NO: 1535) |
| 382 | LAFLYEAMH | (SEQ ID NO: 1536) |
| 381 | VLAFLYEAM | (SEQ ID NO: 1537) |
| 380 | YVLAFLYEA | (SEQ ID NO: 1538) |
| 369 | LPCMGDQPN | (SEQ ID NO: 1539) |
| 368 | RLPCMGDQP | (SEQ ID NO: 1540) |
| 356 | VQAELDQVV | (SEQ ID NO: 1541) |
| 348 | RYPDVQTRV | (SEQ ID NO: 1542) |
| 345 | LFTRYPDVQ | (SEQ ID NO: 1543) |
| 343 | LLLFTRYPD | (SEQ ID NO: 1544) |
| 332 | QDTLSTALQ | (SEQ ID NO: 1545) |
| 325 | TDIEGASQD | (SEQ ID NO: 1546) |
| 313 | ARLDLENVP | (SEQ ID NO: 1547) |
| 310 | GGGARLDLE | (SEQ ID NO: 1548) |
| 302 | KKAAGDSHG | (SEQ ID NO: 1549) |
| 270 | NFILDKFLR | (SEQ ID NO: 1550) |
| 269 | SNFILDKFL | (SEQ ID NO: 1551) |
| 261 | FEQLNRNFS | (SEQ ID NO: 1552) |
| 259 | REFEQLNRN | (SEQ ID NO: 1553) |
| 254 | VRTVFREFE | (SEQ ID NO: 1554) |
| 244 | MPWLQYFPN | (SEQ ID NO: 1555) |
| 236 | GAGSLVDVM | (SEQ ID NO: 1556) |
| 235 | VGAGSLVDV | (SEQ ID NO: 1557) |
| 232 | GRTVGAGSL | (SEQ ID NO: 1558) |
| 223 | ELLSHNEEI: | (SEQ ID NO: 1559) |
| 210 | FGCRYSHDD | (SEQ ID NO: 1560) |
| 201 | VANVMSAVC | (SEQ ID NO: 1561) |
| 199 | VAVANVMSA | (SEQ ID NO: 1562) |
| 191 | LDPRPLTVV | (SEQ ID NO: 1563) |
| 172 | SEARELVAL | (SEQ ID NO: 1564) |
| 166 | LEGHVLSEA | (SEQ ID NO: 1565) |
| 163 | RQVLEGHVS | (SEQ ID NO: 1566) |
| 162 | SRQVLEGHV | (SEQ ID NO: 1567) |
| 159 | QPRSRQVLE | (SEQ ID NO: 1568) |
| 158 | RQPRSRQVL | (SEQ ID NO: 1569) |
| 148 | AHSMMRNFF | (SEQ ID NO: 1570) |
| 139 | EHWKVQRRA | (SEQ ID NO: 1571) |
| 135 | GHYSEHWKV | (SEQ ID NO: 1572) |
| 133 | AFGHYSEHW | (SEQ ID NO: 1573) |
| 127 | SGGRSMAFG | (SEQ ID NO: 1574) |
| 123 | FRVVSGGRS | (SEQ ID NO: 1575) |
| 120 | FASFRVVSG | (SEQ ID NO: 1576) |
| 108 | VQQGSAFAD | (SEQ ID NO: 1577) |
| 107 | LVQQGSAFA | (SEQ ID NO: 1578) |
| 105 | QALVQQGSA | (SEQ ID NO: 1579) |
| 104 | HQALVQQGS | (SEQ ID NO: 1580) |
| 100 | ERAIHQALV | (SEQ ID NO: 1581) |
| 92 | CPIVVLNGE | (SEQ ID NO: 1582) |
| 89 | LGSCPIVVL | (SEQ ID NO: 1583) |

| | | |
|---|---|---|
| 86 | QIRLGSCPI | (SEQ ID NO: 1584) |
| 85 | FQIRLGSCP | (SEQ ID NO: 1585) |
| 79 | RRYGDVFQI | (SEQ ID NO: 1586) |
| 75 | ARLARRYGD | (SEQ ID NO: 1587) |
| 74 | FARLARRYG | (SEQ ID NO: 1588) |
| 58 | PLIGNAAAV | (SEQ ID NO: 1589) |
| 495 | ANPNEPAKM | (SEQ ID NO: 1590) |
| 492 | DFRANPNEP | (SEQ ID NO: 1591) |
| 486 | ILAHQCDFR | (SEQ ID NO: 1592) |
| 481 | FLFLSLLAH | (SEQ ID NO: 1593) |
| 464 | SVGKRRCIG | (SEQ ID NO: 1594) |
| 462 | IFSVGKRRC | (SEQ ID NO: 1595) |
| 456 | LTSRVMIFS | (SEQ ID NO: 1596) |
| 447 | DKDGLINKD | (SEQ ID NO: 1597) |
| 439 | NEDPARFLD | (SEQ ID NO: 1598) |
| 428 | NHDPLKWPN | (SEQ ID NO: 1599) |
| 427 | VNHDPLKWP | (SEQ ID NO: 1600) |
| 415 | PKDTVVFVN | (SEQ ID NO: 1601) |
| 408 | SVLGYHIPK | (SEQ ID NO: 1602) |
| 404 | TANTSVLGY | (SEQ ID NO: 1603) |
| 403 | TTANTSVLG | (SEQ ID NO: 1604) |
| 398 | TIPHATTAN | (SEQ ID NO: 1605) |
| 393 | SFVPVTIPH | (SEQ ID NO: 1606) |
| 379 | PYVLAFLYE | (SEQ ID NO: 1607) |
| 364 | VGRDRLPCM | (SEQ ID NO: 1608) |
| 359 | ELDQVVGRD | (SEQ ID NO: 1609) |
| 357 | QAELDQVVG | (SEQ ID NO: 1610) |
| 318 | ENVPATITD | (SEQ ID NO: 1611) |
| 313 | ARLDLENVP | (SEQ ID NO: 1612) |
| 311 | GGARLDLEN | (SEQ ID NO: 1613) |
| 308 | SHGGGARLD | (SEQ ID NO: 1614) |
| 304 | AAGDSHGGG | (SEQ ID NO: 1615) |
| 302 | KKAAGDSHG | (SEQ ID NO: 1616) |
| 301 | EKKAAGDSH | (SEQ ID NO: 1617) |
| 300 | AEKKAAGDS | (SEQ ID NO: 1618) |
| 298 | LSAEKKAAG | (SEQ ID NO: 1619) |
| 283 | LRPGAAPRD | (SEQ ID NO: 1620) |
| 272 | ILDKFLRHC | (SEQ ID NO: 1621) |
| 271 | FILDKFLRH | (SEQ ID NO: 1622) |
| 236 | GAGSLVDVM | (SEQ ID NO: 1623) |
| 228 | NEEFGRTVG | (SEQ ID NO: 1624) |
| 224 | LLSHNEEFG | (SEQ ID NO: 1625) |
| 220 | EFRELLSHN | (SEQ ID NO: 1626) |
| 208 | VCFGCRYSH | (SEQ ID NO: 1627) |
| 204 | VMSAVCFGC | (SEQ ID NO: 1628) |
| 203 | NVMSAVCFG | (SEQ ID NO: 1629) |
| 198 | VVAVANVMS | (SEQ ID NO: 1630) |
| 195 | PLTVVAVAN | (SEQ ID NO: 1631) |
| 161 | RSRQVLEGH | (SEQ ID NO: 1632) |
| 153 | RNFFTRQPR | (SEQ ID NO: 1633) |
| 145 | RRAAHSMMR | (SEQ ID NO: 1634) |
| 144 | QRRAAHSMM | (SEQ ID NO: 1635) |
| 141 | WKVQRRAAH | (SEQ ID NO: 1636) |
| 136 | HYSEHWKVQ | (SEQ ID NO: 1637) |
| 133 | AFGHYSEHW | (SEQ ID NO: 1638) |
| 129 | GRSMAFGHY | (SEQ ID NO: 1639) |
| 127 | SGGRSMAFG | (SEQ ID NO: 1640) |
| 121 | ASFRVVSGG | (SEQ ID NO: 1641) |
| 110 | QGSAFADRP | (SEQ ID NO: 1642) |
| 109 | QQGSAFADR | (SEQ ID NO: 1643) |
| 108 | VQQGSAFAD | (SEQ ID NO: 1644) |
| 103 | IHQALVQQG | (SEQ ID NO: 1645) |
| 91 | SCPIVVLNG | (SEQ ID NO: 1646) |
| 83 | DVFQIRLGS | (SEQ ID NO: 1647) |
| 80 | RYGDVFQIR | (SEQ ID NO: 1648) |
| 13 | LNPLSIQQT | (SEQ ID NO: 1649) |
| 2 | GTSLSPNDP | (SEQ ID NO: 1650) |
| 516 | FKVNVTLRE | (SEQ ID NO: 1651) |
| 511 | IKPKSFKVN | (SEQ ID NO: 1652) |
| 510 | TIKPKSFKV | (SEQ ID NO: 1653) |
| 487 | LAHQCDFRA | (SEQ ID NO: 1654) |
| 482 | LFISILAHQ | (SEQ ID NO: 1655) |
| 480 | LFLFLSLLA | (SEQ ID NO: 1656) |
| 452 | INKDLTSRV | (SEQ ID NO: 1657) |
| 430 | DPLKWPNPE | (SEQ ID NO: 1658) |
| 429 | HDPLKWPNP | (SEQ ID NO: 1659) |
| 380 | YVLAFLYEA | (SEQ ID NO: 1660) |
| 368 | RLPCMGDQP | (SEQ ID NO: 1661) |
| 357 | QAELDQVVG | (SEQ ID NO: 1662) |
| 350 | PDVQTRVQA | (SEQ ID NO: 1663) |
| 333 | DTLSTALQW | (SEQ ID NO: 1664) |
| 315 | LDLENVPAT | (SEQ ID NO: 1665) |
| 308 | SHGGGARLD | (SEQ ID NO: 1666) |
| 303 | KAAGDSHGG | (SEQ ID NO: 1667) |
| 299 | SAEKKAAGD | (SEQ ID NO: 1668) |
| 292 | MMDAFILSA | (SEQ ID NO: 1669) |
| 274 | DKFLRHCES | (SEQ ID NO: 1670) |
| 237 | AGSLVDVMP | (SEQ ID NO: 1671) |
| 235 | VGAGSLVDV | (SEQ ID NO: 1672) |
| 234 | TVGAGSLVD | (SEQ ID NO: 1673) |
| 228 | NEEFGRTVG | (SEQ ID NO: 1674) |
| 196 | LTVVAVANV | (SEQ ID NO: 1675) |
| 191 | LDPRPLTVV | (SEQ ID NO: 1676) |
| 189 | AFLDPRPLT | (SEQ ID NO: 1677) |
| 187 | DGAFLDPRP | (SEQ ID NO: 1678) |
| 180 | LLVRGSADG | (SEQ ID NO: 1679) |
| 178 | VALLVRGSA | (SEQ ID NO: 1680) |
| 165 | VLEGHVLSE | (SEQ ID NO: 1681) |
| 125 | VVSGGRSMA | (SEQ ID NO: 1682) |
| 118 | PAFASFRVV | (SEQ ID NO: 1683) |
| 105 | QALVQQGSA | (SEQ ID NO: 1684) |
| 94 | IVVLNGERA | (SEQ ID NO: 1685) |
| 92 | CPIVVLNGE | (SEQ ID NO: 1686) |
| 91 | SCPIVVLNG | (SEQ ID NO: 1687) |
| 67 | GQAAHLSFA | (SEQ ID NO: 1688) |
| 61 | GNAAAVGQA | (SEQ ID NO: 1689) |
| 50 | APPGPFAWP | (SEQ ID NO: 1690) |
| 12 | PLNPLSIQQ | (SEQ ID NO: 1691) |
| 11 | WPLNPLSIQ | (SEQ ID NO: 1692) |
| 1 | MGTSLSPND | (SEQ ID NO: 1693) |
| 529 | LDSAVQNLQ | (SEQ ID NO: 1694) |
| 525 | SMELLDSAV | (SEQ ID NO: 1695) |
| 524 | ESMELLDSA | (SEQ ID NO: 1696) |
| 517 | KVNVTLRES | (SEQ ID NO: 1697) |
| 513 | PKSFKVNVT | (SEQ ID NO: 1698) |
| 484 | ISILAHQCD | (SEQ ID NO: 1699) |
| 477 | KMQLFLFIS | (SEQ ID NO: 1700) |
| 471 | IGEELSKMQ | (SEQ ID NO: 1701) |
| 457 | TSRVMIFSV | (SEQ ID NO: 1702) |
| 433 | KWPNPENFD | (SEQ ID NO: 1703) |
| 431 | PLKWPNPEN | (SEQ ID NO: 1704) |
| 428 | NHDPLKWPN | (SEQ ID NO: 1705) |
| 417 | DTVVFVNQW | (SEQ ID NO: 1706) |
| 407 | TSVLGYHIP | (SEQ ID NO: 1707) |
| 78 | ARRYGDVFQ | (SEQ ID NO: 1708) |
| 74 | FARLARRYG | (SEQ ID NO: 1709) |
| 73 | SFARLARRY | (SEQ ID NO: 1710) |
| 54 | PFAWPLIGN | (SEQ ID NO: 1711) |
| 52 | PGPFAWPLI | (SEQ ID NO: 1712) |
| 534 | QNLQAKETC | (SEQ ID NO: 1713) |
| 526 | MELLDSAVQ | (SEQ ID NO: 1714) |
| 516 | FKVNVTLRE | (SEQ ID NO: 1715) |
| 489 | HQCDFRANP | (SEQ ID NO: 1716) |
| 484 | ISILAHQCD | (SEQ ID NO: 1717) |
| 462 | IFSVGKRRC | (SEQ ID NO: 1718) |
| 453 | NKDLTSRVM | (SEQ ID NO: 1719) |
| 378 | LPYVLAFLY | (SEQ ID NO: 1720) |
| 369 | LPCMGDQPN | (SEQ ID NO: 1721) |
| 353 | QTRVQAELD | (SEQ ID NO: 1722) |
| 349 | YPDVQTRVQ | (SEQ ID NO: 1723) |
| 306 | GDSHGGGAR | (SEQ ID NO: 1724) |
| 288 | APRDMMDAF | (SEQ ID NO: 1725) |
| 285 | PGAAPRDMM | (SEQ ID NO: 1726) |
| 284 | RPGAAPRDM | (SEQ ID NO: 1727) |
| 257 | VFREFEQLN | (SEQ ID NO: 1728) |
| 252 | NPVRTVFRE | (SEQ ID NO: 1729) |
| 250 | FPNPVRTVF | (SEQ ID NO: 1730) |
| 247 | LQYFPNPVR | (SEQ ID NO: 1731) |
| 237 | AGSLVDVMP | (SEQ ID NO: 1732) |
| 231 | FGRTVGAGS | (SEQ ID NO: 1733) |
| 220 | EFRELLSHN | (SEQ ID NO: 1734) |
| 215 | SHDDPEFRE | (SEQ ID NO: 1735) |
| 202 | ANVMSAVCF | (SEQ ID NO: 1736) |
| 160 | PRSRQVLEG | (SEQ ID NO: 1737) |
| 144 | QRRAAHSMM | (SEQ ID NO: 1738) |
| 140 | HWKVQRRAA | (SEQ ID NO: 1739) |
| 127 | SGGRSMAFG | (SEQ ID NO: 1740) |
| 126 | VSGGRSMAF | (SEQ ID NO: 1741) |

-continued

| | | |
|---|---|---|
| 108 | VQQGSAFAD | (SEQ ID NO: 1742) |
| 97 | LNGERAIHQ | (SEQ ID NO: 1743) |
| 85 | FQIRLGSCP | (SEQ ID NO: 1744) |
| 82 | GDVFQIRLG | (SEQ ID NO: 1745) |
| 66 | VGQAAHLSF | (SEQ ID NO: 1746) |
| 33 | VHVGQRLLR | (SEQ ID NO: 1747) |
| 9 | DPWPLNPLS | (SEQ ID NO: 1748) |
| 529 | LDSAVQNLQ | (SEQ ID NO: 1749) |
| 519 | NVTLRESME | (SEQ ID NO: 1750) |
| 496 | NPNEPAKMN | (SEQ ID NO: 1751) |
| 488 | AHQCDFRAN | (SEQ ID NO: 1752) |
| 471 | IGEELSKMQ | (SEQ ID NO: 1753) |
| 435 | PNPENFDPA | (SEQ ID NO: 1754) |
| 434 | WPNPENFDP | (SEQ ID NO: 1755) |
| 433 | KWPNPENFD | (SEQ ID NO: 1756) |
| 428 | NHDPLKWPN | (SEQ ID NO: 1757) |
| 418 | TVVFVNQWS | (SEQ ID NO: 1758) |
| 407 | TSVLGYHIP | (SEQ ID NO: 1759) |
| 385 | LYEAMRFSS | (SEQ ID NO: 1760) |
| 383 | AFLYEAMRF | (SEQ ID NO: 1761) |
| 367 | DRLPCMGDQ | (SEQ ID NO: 1762) |
| 350 | PDVQTRVQA | (SEQ ID NO: 1763) |
| 332 | QDTLSTALQ | (SEQ ID NO: 1764) |
| 328 | FGASQDTLS | (SEQ ID NO: 1765) |
| 325 | TDIFGASQD | (SEQ ID NO: 1766) |
| 56 | AWPLIGNAA | (SEQ ID NO: 1767) |
| 52 | PGPFAWPLI | (SEQ ID NO: 1768) |
| 42 | QRRRQLRSA | (SEQ ID NO: 1769) |
| 39 | LLRQRRRQL | (SEQ ID NO: 1770) |
| 26 | LLSVLATVH | (SEQ ID NO: 1771) |
| 22 | TLLLLLSVL | (SEQ ID NO: 1772) |
| 535 | NLQAKETCQ | (SEQ ID NO: 1773) |
| 527 | ELLDSAVQN | (SEQ ID NO: 1774) |
| 526 | MELLDSAVQ | (SEQ ID NO: 1775) |
| 519 | NVTLRESME | (SEQ ID NO: 1776) |
| 508 | GLTIKPKSF | (SEQ ID NO: 1777) |
| 501 | AKMNFSYGL | (SEQ ID NO: 1778) |
| 491 | CDFRANPNE | (SEQ ID NO: 1779) |
| 489 | HQCDFRANP | (SEQ ID NO: 1780) |
| 483 | FISILAHQC | (SEQ ID NO: 1781) |
| 479 | QLFLFLSLL | (SEQ ID NO: 1782) |
| 467 | KRRCIGEEL | (SEQ ID NO: 1783) |
| 448 | KDGLINKDL | (SEQ ID NO: 1784) |
| 443 | ARFLDKDGL | (SEQ ID NO: 1785) |
| 438 | ENFDPARFL | (SEQ ID NO: 1786) |
| 433 | KWPNPENFD | (SEQ ID NO: 1787) |
| 421 | FVNQWSVNH | (SEQ ID NO: 1788) |
| 419 | VVFVNQWSV | (SEQ ID NO: 1789) |
| 414 | IPKDTVVFV | (SEQ ID NO: 1790) |
| 413 | HIPKDTVVF | (SEQ ID NO: 1791) |
| 411 | GYHIPKDTV | (SEQ ID NO: 1792) |
| 401 | HATTANTSV | (SEQ ID NO: 1793) |
| 396 | PVTIPHATT | (SEQ ID NO: 1794) |
| 395 | VPVTIPHAT | (SEQ ID NO: 1795) |
| 394 | FVPVTIPHA | (SEQ ID NO: 1796) |
| 383 | AFLYEAMRF | (SEQ ID NO: 1797) |
| 374 | DQPNLPYVL | (SEQ ID NO: 1798) |
| 370 | PCMGDQPNL | (SEQ ID NO: 1799) |
| 366 | RDRLPCMGD | (SEQ ID NO: 1800) |
| 364 | VGRDRLPCM | (SEQ ID NO: 1801) |
| 351 | DVQTRVQAE | (SEQ ID NO: 1802) |
| 350 | PDVQTRVQA | (SEQ ID NO: 1803) |
| 344 | LLFTRYPDV | (SEQ ID NO: 1804) |
| 342 | LLLLFTRYP | (SEQ ID NO: 1805) |
| 334 | TLSTALQWS- | (SEQ ID NO: 1806) |
| 326 | DIFGASQDT | (SEQ ID NO: 1807) |
| 320 | VPATLTDLF | (SEQ ID NO: 1808) |
| 317 | LENVPATIT | (SEQ ID NO: 1809) |
| 315 | LDLENVPAT | (SEQ ID NO: 1810) |
| 304 | AAGDSHGGG | (SEQ ID NO: 1811) |
| 303 | KAAGDSHGG | (SEQ ID NO: 1812) |
| 301 | EKKAAGDSH | (SEQ ID NO: 1813) |
| 300 | AEKKAAGDS | (SEQ ID NO: 1814) |
| 297 | ILSAEKKAA | (SEQ ID NO: 1815) |
| 288 | APRDMMDAF | (SEQ ID NO: 1816) |
| 287 | AAPRDMMDA | (SEQ ID NO: 1817) |
| 283 | LRPGAAPRD | (SEQ ID NO: 1818) |
| 273 | LDKFLRHCE | (SEQ ID NO: 1819) |
| 265 | NRNFSNFIL | (SEQ ID NO: 1820) |
| 262 | EQLNRNFSN | (SEQ ID NO: 1821) |
| 252 | NPVRTVFRE | (SEQ ID NO: 1822) |
| 246 | WLQYFPNPV | (SEQ ID NO: 1823) |
| 243 | VMPWLQYFP | (SEQ ID NO: 1824) |
| 230 | EFGRTVGAG | (SEQ ID NO: 1825) |
| 74 | FARLARRYG | (SEQ ID NO: 1826) |
| 65 | AVGQAAHLS | (SEQ ID NO: 1827) |
| 59 | LIGNAAAVG | (SEQ ID NO: 1828) |
| 46 | QLRSAPPGP | (SEQ ID NO: 1829) |
| 45 | RQLRSAPPG | (SEQ ID NO: 1830) |
| 44 | RRQLRSAPP | (SEQ ID NO: 1831) |
| 36 | GQRLLRQRR | (SEQ ID NO: 1832) |
| 34 | HVGQRLLRQ | (SEQ ID NO: 1833) |
| 29 | VLATVHVGQ | (SEQ ID NO: 1834) |
| 28 | SVLATVHVG | (SEQ ID NO: 1835) |
| 535 | NLQAKETCQ | (SEQ ID NO: 1836) |
| 526 | MELLDSAVQ | (SEQ ID NO: 1837) |
| 522 | LRESMELLD | (SEQ ID NO: 1838) |
| 515 | SFKVNVTLR | (SEQ ID NO: 1839) |
| 506 | SYGLTIKPK | (SEQ ID NO: 1840) |
| 498 | NEPAKMNFS | (SEQ ID NO: 1841) |
| 490 | QCDFRANPN | (SEQ ID NO: 1842) |
| 489 | HQCDFRANP | (SEQ ID NO: 1843) |
| 483 | FLSLLAHQC | (SEQ ID NO: 1844) |
| 466 | GKRRCIGEE | (SEQ ID NO: 1845) |
| 458 | SRVMIFGSVG | (SEQ ID NO: 1846) |
| 453 | NKDLTSRVM | (SEQ ID NO: 1847) |
| 451 | LINKDLTSR | (SEQ ID NO: 1848) |
| 450 | GLINKDLTS | (SEQ ID NO: 1849) |
| 442 | PARFLDKDG | (SEQ ID NO: 1850) |
| 426 | SVNHDPLKW | (SEQ ID NO: 1851) |
| 421 | FVNQWSVNH | (SEQ ID NO: 1852) |
| 409 | VLGYHIPKD | (SEQ ID NO: 1853) |
| 405 | ANTSVLGYH | (SEQ ID NO: 1854) |
| 385 | LYEAMRFSS | (SEQ ID NO: 1855) |
| 381 | VLAFLYEAM | (SEQ ID NO: 1856) |
| 368 | RLPCMGDQP | (SEQ ID NO: 1857) |
| 362 | QVVGRDRLP | (SEQ ID NO: 1858) |
| 354 | TRVQAELDQ | (SEQ ID NO: 1859) |
| 353 | QTRVQAELD | (SEQ ID NO: 1860) |
| 351 | DVQTRVQAE | (SEQ ID NO: 1861) |
| 347 | TRYPDVQTR | (SEQ ID NO: 1862) |
| 343 | LLLFTRYPD | (SEQ ID NO: 1863) |
| 341 | WLLLLFTRY | (SEQ ID NO: 1864) |
| 333 | DTLSTALQW | (SEQ ID NO: 1865) |
| 332 | QDTLSTALQ | (SEQ ID NO: 1866) |
| 328 | FGASQDTLS | (SEQ ID NO: 1867) |
| 323 | TLTDLFGAS | (SEQ ID NO: 1868) |
| 310 | GGGARLDLE | (SEQ ID NO: 1869) |
| 299 | SAEKKAAGD | (SEQ ID NO: 1870) |
| 295 | AFILSAEKK | (SEQ ID NO: 1871) |
| 293 | MDAFILSAE | (SEQ ID NO: 1872) |
| 291 | DMMDAFILS | (SEQ ID NO: 1873) |
| 286 | GAAPRDMMD | (SEQ ID NO: 1874) |
| 278 | RHCESLRPG | (SEQ ID NO: 1875) |
| 277 | LRHCESLRP | (SEQ ID NO: 1876) |
| 276 | FLRHCESLR | (SEQ ID NO: 1877) |
| 266 | RNFSNFILD | (SEQ ID NO: 1878) |
| 261 | FEQLNRNFS | (SEQ ID NO: 1879) |
| 258 | FREFEQLNR | (SEQ ID NO: 1880) |
| 257 | VFREFEQLN | (SEQ ID NO: 1881) |
| 254 | VRTVFREFE | (SEQ ID NO: 1882) |
| 245 | PWLQYFPNP | (SEQ ID NO: 1883) |
| 238 | GSLVDVMPW | (SEQ ID NO: 1884) |
| 401 | HATTANTSV | (SEQ ID NO: 1885) |
| 399 | IPHATTANT | (SEQ ID NO: 1886) |
| 394 | FVPVTIPHA | (SEQ ID NO: 1887) |
| 388 | AMRFSSFVP | (SEQ ID NO: 1888) |
| 362 | QVVGRDRLP | (SEQ ID NO: 1889) |
| 356 | VQAELDQVV | (SEQ ID NO: 1890) |
| 346 | FTRYPDVQT | (SEQ ID NO: 1891) |
| 344 | LLFTRYPDV | (SEQ ID NO: 1892) |
| −339 | LQWLLLLFT | (SEQ ID NO: 1893) |
| 330 | ASQDTLSTA | (SEQ ID NO: 1894) |
| 318 | ENVPATITD | (SEQ ID NO: 1895) |
| 317 | LENVPATIT | (SEQ ID NO: 1896) |
| 310 | GGGARLDLE | (SEQ ID NO: 1897) |
| 300 | AEKKAAGDS | (SEQ ID NO: 1898) |
| 298 | LSAEKKAAG | (SEQ ID NO: 1899) |

-continued

| | | |
|---|---|---|
| 296 | FILSAEKKA | (SEQ ID NO: 1900) |
| 281 | ESLRPGAAP | (SEQ ID NO: 1901) |
| 272 | ILDKFLRHC | (SEQ ID NO: 1902) |
| 262 | EQLNRNFSN | (SEQ ID NO: 1903) |
| 252 | NPVRTVFRE | (SEQ ID NO: 1904) |
| 243 | VMPWLQYFP | (SEQ ID NO: 1905) |
| 226 | SHNEEFGRT | (SEQ ID NO: 1906) |
| 220 | EFRELLSHN | (SEQ ID NO: 1907) |
| 211 | GCRYSHDDP | (SEQ ID NO: 1908) |
| 199 | VAVANVMSA | (SEQ ID NO: 1909) |
| 192 | DPRPLTVVA | (SEQ ID NO: 1910) |
| 181 | LVRGSADGA | (SEQ ID NO: 1911) |
| 179 | ALLVRGSAD | (SEQ ID NO: 1912) |
| 166 | LEGHVLSEA | (SEQ ID NO: 1913) |
| 151 | MMRNFFTRQ | (SEQ ID NO: 1914) |
| 142 | KVQRRAAHS | (SEQ ID NO: 1915) |
| 131 | SMAFGHYSE | (SEQ ID NO: 1916) |
| 130 | RSMAFGHYS | (SEQ ID NO: 1917) |
| 111 | GSAFADRPA | (SEQ ID NO: 1918) |
| 108 | VQQGSAFAD | (SEQ ID NO: 1919) |
| 104 | HQALVQQGS | (SEQ ID NO: 1920) |
| 103 | IHQALVQQG | (SEQ ID NO: 1921) |
| 98 | NGERAIHQA | (SEQ ID NO: 1922) |
| 85 | FQIRLGSCP | (SEQ ID NO: 1923) |
| 76 | RLARRYGDV | (SEQ ID NO: 1924) |
| 70 | AHLSFARLA | (SEQ ID NO: 1925) |
| 65 | AVGQAAHLS | (SEQ ID NO: 1926) |
| 56 | AWPLIGNAA | (SEQ ID NO: 1927) |
| 28 | SVLATVHVG | (SEQ ID NO: 1928) |
| 20 | QTTLLLLLS | (SEQ ID NO: 1929) |
| 9 | DPWPLNPLS | (SEQ ID NO: 1930) |
| 7 | PNDPWPLNP | (SEQ ID NO: 1931) |
| 3 | TSLSPNDPW | (SEQ ID NO: 1932) |
| 535 | NLQAKETCQ | (SEQ ID NO: 1933) |
| 533 | VQNLQAKET | (SEQ ID NO: 1934) |
| 530 | DSAVQNLQA | (SEQ ID NO: 1935) |
| 502 | KMNFSYGLT | (SEQ ID NO: 1936) |
| 496 | NPNEPAKMN | (SEQ ID NO: 1937) |
| 489 | HQCDFRANP | (SEQ ID NO: 1938) |
| 483 | FLSLLAHQC | (SEQ ID NO: 1939) |
| 449 | DGLINKDLT | (SEQ ID NO: 1940) |
| 445 | FLDKDGLIN | (SEQ ID NO: 1941) |
| 441 | DPARFLDKD | (SEQ ID NO: 1942) |
| 434 | WPNPENFDP | (SEQ ID NO: 1943) |
| 318 | ENVPATITD | (SEQ ID NO: 1944) |
| 281 | ESLRPGAAP | (SEQ ID NO: 1945) |
| 277 | LRHCESLRP | (SEQ ID NO: 1946) |
| 253 | PVRTVFREF | (SEQ ID NO: 1947) |
| 241 | VDVMPWLQY | (SEQ ID NO: 1948) |
| 225 | LSHNEEFGR | (SEQ ID NO: 1949) |
| 214 | YSHDDPEFR | (SEQ ID NO: 1950) |
| 213 | RYSHDDPEF | (SEQ ID NO: 1951) |
| 210 | FGCRYSHDD | (SEQ ID NO: 1952) |
| 168 | GHVLSEARE | (SEQ ID NO: 1953) |
| 152 | MRNFFTRQP | (SEQ ID NO: 1954) |
| 148 | AHSMMRNFF | (SEQ ID NO: 1955) |
| 141 | WKVQRRAAH | (SEQ ID NO: 1956) |
| 137 | YSEHWKVQR | (SEQ ID NO: 1957) |
| 133 | AFGHYSEHW | (SEQ ID NO: 1958) |
| 130 | RSMAFGHYS | (SEQ ID NO: 1959) |
| 122 | SFRVVSGGR | (SEQ ID NO: 1960) |
| 104 | HQALVQQGS | (SEQ ID NO: 1961) |
| 53 | GPFAWPLIG | (SEQ ID NO: 1962) |
| 47 | LRSAPPGPF | (SEQ ID NO: 1963) |
| 45 | RQLRSAPPG | (SEQ ID NO: 1964) |
| 3 | TSLSPNDPW | (SEQ ID NO: 1965) |
| 522 | LRESMELLD | (SEQ ID NO: 1966) |
| 498 | NEPAKMNFS | (SEQ ID NO: 1967) |
| 492 | DFRANPNEP | (SEQ ID NO: 1968) |
| 491 | CDFRANPNE | (SEQ ID NO: 1969) |
| 468 | RRCIGEELS | (SEQ ID NO: 1970) |
| 458 | SRVMIFSVG | (SEQ ID NO: 1971) |
| 440 | FDPARFLDK | (SEQ ID NO: 1972) |
| 439 | NFDPARFLD | (SEQ ID NO: 1973) |
| 436 | NPENFDPAR | (SEQ ID NO: 1974) |
| 430 | DPLKWPNPE | (SEQ ID NO: 1975) |
| 429 | HDPLKWPNP | (SEQ ID NO: 1976) |
| 423 | NQWSVNHDP | (SEQ ID NO: 1977) |
| 416 | KDTVVFVNQ | (SEQ ID NO: 1978) |
| 400 | PHATTANTS | (SEQ ID NO: 1979) |
| 372 | MGDQPNLPY | (SEQ ID NO: 1980) |
| 366 | RDRLPCMGD | (SEQ ID NO: 1981) |
| 365 | GRDRLPCMG | (SEQ ID NO: 1982) |
| 360 | LDQVVGRDR | (SEQ ID NO: 1983) |
| 345 | LFTRYPDVQ | (SEQ ID NO: 1984) |
| 274 | DKFLRHCES | (SEQ ID NO: 1985) |
| 273 | LDKFLRHCE | (SEQ ID NO: 1986) |
| 270 | NFILDKFLR | (SEQ ID NO: 1987) |
| 261 | FEQLNRNFS | (SEQ ID NO: 1988) |
| 230 | EFGRTVGAG | (SEQ ID NO: 1989) |
| 221 | FRELLSHNE | (SEQ ID NO: 1990) |
| 205 | MSAVCFGCR | (SEQ ID NO: 1991) |
| 187 | DGAFLDPRP | (SEQ ID NO: 1992) |
| 182 | VRGSADGAF | (SEQ ID NO: 1993) |
| 159 | QPRSRQVLE | (SEQ ID NO: 1994) |
| 155 | FFTRQPRSR | (SEQ ID NO: 1995) |
| 154 | NFFTRQPRS | (SEQ ID NO: 1996) |
| 145 | RRAAHSMMR | (SEQ ID NO: 1997) |
| 139 | EHWKVQRRA | (SEQ ID NO: 1998) |
| 128 | GGRSMAFGH | (SEQ ID NO: 1999) |
| 229 | EEFGRTVGA | (SEQ ID NO: 2000) |
| 224 | LLSHNEEFG | (SEQ ID NO: 2001) |
| 203 | NVMSAVCFG | (SEQ ID NO: 2002) |
| 202 | ANVMSAVCF | (SEQ ID NO: 2003) |
| 193 | PRPLTVVAV | (SEQ ID NO: 2004) |
| 186 | ADGAFLDPR | (SEQ ID NO: 2005) |
| 183 | RGSADGAFL | (SEQ ID NO: 2006) |
| 182 | VRGSADGAF | (SEQ ID NO: 2007) |
| 181 | LVRGSADGA | (SEQ ID NO: 2008) |
| 177 | LVALLVRGS | (SEQ ID NO: 2009) |
| 176 | ELVALLVRG | (SEQ ID NO: 2010) |
| 153 | RNFFTRQPR | (SEQ ID NO: 2011) |
| 147 | AAHSMMRNF | (SEQ ID NO: 2012) |
| 145 | RRAAHSMMR | (SEQ ID NO: 2013) |
| 144 | QRRAAHSMM | (SEQ ID NO: 2014) |
| 143 | VQRRAAHSM | (SEQ ID NO: 2015) |
| 141 | WKVQRRAAH | (SEQ ID NO: 2016) |
| 136 | HYSEHWKVQ | (SEQ ID NO: 2017) |
| 134 | FGHYSEHWK | (SEQ ID NO: 2018) |
| 132 | MAFGHYSEH | (SEQ ID NO: 2019) |
| 113 | AFADRPAFA | (SEQ ID NO: 2020) |
| 103 | IHQALVQQG | (SEQ ID NO: 2021) |
| 102 | AIHQALVQQ | (SEQ ID NO: 2022) |
| 94 | IVVLNGERA | (SEQ ID NO: 2023) |
| 93 | PIVVLNGER | (SEQ ID NO: 2024) |
| 87 | IRLGSCPIV | (SEQ ID NO: 2025) |
| 84 | VFQIRLGSC | (SEQ ID NO: 2026) |
| 76 | RLARRYGDV | (SEQ ID NO: 2027) |
| 61 | GNAAAVGQA | (SEQ ID NO: 2028) |
| 59 | LIGNAAAVG | (SEQ ID NO: 2029) |
| 47 | LRSAPPGPF | (SEQ ID NO: 2030) |
| 46 | QLRSAPPGP | (SEQ ID NO: 2031) |
| 43 | RRRQLRSAP | (SEQ ID NO: 2032) |
| 36 | GQRLLRQRR | (SEQ ID NO: 2033) |
| 35 | VGQRLLRQR | (SEQ ID NO: 2034) |
| 30 | LATVHVGQR | (SEQ ID NO: 2035) |
| 11 | WPLNPLSIQ | (SEQ ID NO: 2036) |
| 8 | NDPWPLNPL | (SEQ ID NO: 2037) |
| 240 | LVDVMPWLQY | (SEQ ID NO: 2038) |
| 403 | TTANTSVLGY | (SEQ ID NO: 2039) |
| 439 | NFDPARFLDK | (SEQ ID NO: 2040) |
| 371 | CMGDQPNLPY | (SEQ ID NO: 2041) |
| 205 | MSAVCFGCRY | (SEQ ID NO: 2042) |
| 72 | LSFARLARRY | (SEQ ID NO: 2043) |
| 377 | NLPYVLATY | (SEQ ID NO: 2044) |
| 340 | QWLLLLFTttY | (SEQ ID NO: 2045) |
| 174 | ARELVALLVR | (SEQ ID NO: 2046) |
| 128 | GGRSMAFGHY | (SEQ ID NO: 2047) |
| 216 | HDDPEFRELL | (SEQ ID NO: 2048) |
| 190 | FLDPRPLTVV | (SEQ ID NO: 2049) |
| 137 | YSEHWKVQRR | (SEQ ID NO: 2050) |
| 522 | LRESMELLDSI | (SEQ ID NO: 2051) |
| 219 | PEFRELLSH | (SEQ ID NO: 2052) |
| 211 | GCRYSHDDP | (SEQ ID NO: 2053) |
| 207 | AVCFGCRYS | (SEQ ID NO: 2054) |
| 205 | MSAVCFGCR | (SEQ ID NO: 2055) |
| 201 | VANVMSAVC | (SEQ ID NO: 2056) |
| 197 | TVVAVANVM | (SEQ ID NO: 2057) |

-continued

| | | |
|---|---|---|
| 187 | DGAFLDPRP | (SEQ ID NO: 2058) |
| 177 | LVALLVRGS | (SEQ ID NO: 2059) |
| 167 | EGHVLSEAR | (SEQ ID NO: 2060) |
| 164 | QVLEGHVLS | (SEQ ID NO: 2061) |
| 150 | SMMRNFFTR | (SEQ ID NO: 2062) |
| 146 | RAAHSMMRN | (SEQ ID NO: 2063) |
| 143 | VQRRAAHSM | (SEQ ID NO: 2064) |
| 142 | KVQRRAAHS | (SEQ ID NO: 2065) |
| 137 | YSEHWKVQR | (SEQ ID NO: 2066) |
| 132 | MAFGHYSEH | (SEQ ID NO: 2067) |
| 128 | GGRSMAFGH | (SEQ ID NO: 2068) |
| 124 | RVVSGGRSM | (SEQ ID NO: 2069) |
| 122 | SFRVVSGGR | (SEQ ID NO: 2070) |
| 116 | DRPAFASFR | (SEQ ID NO: 2071) |
| 72 | LSFARLARR | (SEQ ID NO: 2072) |
| 68 | QAAHLSFAR | (SEQ ID NO: 2073) |
| 49 | SAPPGPFAW | (SEQ ID NO: 2074) |
| 38 | RLLRQRRRQ | (SEQ ID NO: 2075) |
| 20 | QTTLLLLLS | (SEQ ID NO: 2076) |
| 2 | GTSLSPNDP | (SEQ ID NO: 2077) |
| 531 | SAVQNLQAK | (SEQ ID NO: 2078) |
| 518 | VNVTLRESM | (SEQ ID NO: 2079) |
| 517 | KVNVTLRES | (SEQ ID NO: 2080) |
| 507 | YGLTIKPKS | (SEQ ID NO: 2081) |
| 500 | PAKMNFSYG | (SEQ ID NO: 2082) |
| 491 | CDFRANPNE | (SEQ ID NO: 2083) |
| 484 | ISILAHQCD | (SEQ ID NO: 2084) |
| 482 | LFLSLLAHQ | (SEQ ID NO: 2085) |
| 477 | KMQLFLFIS | (SEQ ID NO: 2086) |
| 471 | IGEELSKMQ | (SEQ ID NO: 2087) |
| 470 | CIGEELSKM | (SEQ ID NO: 2088) |
| 468 | RRCIGEELS | (SEQ ID NO: 2089) |
| 461 | MIFSVGKRR | (SEQ ID NO: 2090) |
| 460 | VMIFSVGKR | (SEQ ID NO: 2091) |
| 429 | HDPLKWPNP | (SEQ ID NO: 2092) |
| 425 | WSVNHDPLK | (SEQ ID NO: 2093) |
| 422 | VNQWSVNHD | (SEQ ID NO: 2094) |
| 420 | VFVNQWSVN | (SEQ ID NO: 2095) |
| 417 | DTVVFVNQW | (SEQ ID NO: 2096) |
| 400 | PHATTANTS | (SEQ ID NO: 2097) |
| 384 | FLYEAMRFS | (SEQ ID NO: 2098) |
| 382 | LAFLYEAMR | (SEQ ID NO: 2099) |
| 371 | CMGDQPNLP | (SEQ ID NO: 2100) |
| 367 | DRLPCMGDQ | (SEQ ID NO: 2101) |
| 365 | GRDRLPCMG | (SEQ ID NO: 2102) |
| 360 | LDQVVGRDR | (SEQ ID NO: 2103) |
| 345 | LFTRYPDVQ | (SEQ ID NO: 2104) |
| 342 | LLLLFTRYP | (SEQ ID NO: 2105) |
| 321 | PATLTDLFG | (SEQ ID NO: 2106) |
| 294 | DAFILSAEK | (SEQ ID NO: 2107) |
| 426 | SVNHDPLKW | (SEQ ID NO: 2108) |
| 422 | VNQWSVNHD | (SEQ ID NO: 2109) |
| 420 | VFVNQWSVN | (SEQ ID NO: 2110) |
| 418 | TVVFVNQWS | (SEQ ID NO: 2111) |
| 415 | PKDTVVFVN | (SEQ ID NO: 2112) |
| 414 | IPKDTVVFV | (SEQ ID NO: 2113) |
| 410 | LGYHIPKDT | (SEQ ID NO: 2114) |
| 400 | PHATTANTS | (SEQ ID NO: 2115) |
| 396 | PVTIPHATT | (SEQ ID NO: 2116) |
| 384 | FLYEAMRFS | (SEQ ID NO: 2117) |
| 379 | PYVLAFLYE | (SEQ ID NO: 2118) |
| 375 | QPNLPYVLA | (SEQ ID NO: 2119) |
| 369 | LPCMGDQPN | (SEQ ID NO: 2120) |
| 343 | LLLFTRYPD | (SEQ ID NO: 2121) |
| 342 | LLLLFTRYP | (SEQ ID NO: 2122) |
| 332 | QDTLSTALQ | (SEQ ID NO: 2123) |
| 328 | FGASQDTLS | (SEQ ID NO: 2124) |
| 324 | ITDIFGASQ | (SEQ ID NO: 2125) |
| 297 | ILSAEKKAA | (SEQ ID NO: 2126) |
| 293 | MDAFILSAE | (SEQ ID NO: 2127) |
| 249 | YFPNPVRTV | (SEQ ID NO: 2128) |
| 215 | SHDDPEFRE | (SEQ ID NO: 2129) |
| 207 | AVCFGCRYS | (SEQ ID NO: 2130) |
| 201 | VANVMSAVC | (SEQ ID NO: 2131) |
| 200 | AVANVMSAV | (SEQ ID NO: 2132) |
| 195 | PLTVVAVAN | (SEQ ID NO: 2133) |
| 190 | FLDPRPLTV | (SEQ ID NO: 2134) |
| 185 | SADGAFLDP | (SEQ ID NO: 2135) |
| 177 | LVALLVRGS | (SEQ ID NO: 2136) |

-continued

| | | |
|---|---|---|
| 159 | QPRSRQVLE | (SEQ ID NO: 2137) |
| 120 | FASFRVVSG | (SEQ ID NO: 2138) |
| 119 | AFASFRVVS | (SEQ ID NO: 2139) |
| 110 | QGSAFADRP | (SEQ ID NO: 2140) |
| 97 | LNGERAIHQ | (SEQ ID NO: 2141) |
| 60 | IGNAAAVGQ | (SEQ ID NO: 2142) |
| 59 | LIGNAAAVG | (SEQ ID NO: 2143) |
| 54 | PFAWPLIGN | (SEQ ID NO: 2144) |
| 49 | SAPPGPFAW | (SEQ ID NO: 2145) |
| 27 | LSVLATVHV | (SEQ ID NO: 2146) |
| 4 | SLSPNDPWP | (SEQ ID NO: 2147) |
| 519 | NVTLRESME | (SEQ ID NO: 2148) |
| 498 | NEPAKMNFS | (SEQ ID NO: 2149) |
| 492 | DFRANPNEP | (SEQ ID NO: 2150) |
| 490 | QCDFRANPN | (SEQ ID NO: 2151) |
| 464 | SVGKRRCIG | (SEQ ID NO: 2152) |
| 456 | LTSRVMIFS | (SEQ ID NO: 2153) |
| 442 | PARFLDKDG | (SEQ ID NO: 2154) |
| 427 | VNHDPLKWP | (SEQ ID NO: 2155) |
| 423 | NQWSVNHDP | (SEQ ID NO: 2156) |
| 403 | TTANTSVLG | (SEQ ID NO: 2157) |
| 398 | TIPHATTAN | (SEQ ID NO: 2158) |
| 395 | VPVTIPHAT | (SEQ ID NO: 2159) |
| 387 | EAMRFSSFV | (SEQ ID NO: 2160) |
| 321 | PATLTDLFG | (SEQ ID NO: 2161) |
| 304 | AAGDSHGGG | (SEQ ID NO: 2162) |
| 287 | AAPRDMMDA | (SEQ ID NO: 2163) |
| 109 | QQGSAFADR | (SEQ ID NO: 2164) |
| 44 | RRQLRSAPP | (SEQ ID NO: 2165) |
| 43 | RRRQLRSAP | (SEQ ID NO: 2166) |
| 40 | LRQRRRQLR | (SEQ ID NO: 2167) |
| 37 | QRLLRQRRR | (SEQ ID NO: 2168) |
| 36 | GQRLLRQRR | (SEQ ID NO: 2169) |
| 511 | IKPKSFKVN | (SEQ ID NO: 2170) |
| 499 | EPAKMNFSY | (SEQ ID NO: 2171) |
| 465 | VGKRRCIGE | (SEQ ID NO: 2172) |
| 425 | WSVNHDPLK | (SEQ ID NO: 2173) |
| 420 | VFVNQWSVN | (SEQ ID NO: 2174) |
| 415 | PKDTVVFVN | (SEQ ID NO: 2175) |
| 354 | TRVQAELDQ | (SEQ ID NO: 2176) |
| 300 | AEKKAAGDS | (SEQ ID NO: 2177) |
| 266 | RNFSNFILD | (SEQ ID NO: 2178) |
| 262 | EQLNRFSN | (SEQ ID NO: 2179) |
| 254 | VRTVFREFE | (SEQ ID NO: 2180) |
| 251 | PNPVRTVFR | (SEQ ID NO: 2181) |
| 245 | PWLQYFPNP | (SEQ ID NO: 2182) |
| 244 | MPWLQYFPN | (SEQ ID NO: 2183) |
| 212 | CRYSHDDPE | (SEQ ID NO: 2184) |
| 136 | HYSEHWKVQ | (SEQ ID NO: 2185) |
| 134 | FGHYSEHWK | (SEQ ID NO: 2186) |
| 129 | GRSMAFGHY | (SEQ ID NO: 2187) |
| 123 | FRVVSGGRS | (SEQ ID NO: 2188) |
| 110 | QGSAFADRP | (SEQ ID NO: 2189) |
| 80 | RYGDVFQIR | (SEQ ID NO: 2190) |
| 41 | RQRRRQLRS | (SEQ ID NO: 2191) |
| 1 | MGTSLSPND | (SEQ ID NO: 2192) |
| 437 | PENFDPARF | (SEQ ID NO: 2193) |
| 167 | EGHVLSEAR | (SEQ ID NO: 2194) |
| 497 | PNEPAKMNF | (SEQ ID NO: 2195) |
| 379 | PYVLAFLYE | (SEQ ID NO: 2196) |
| 301 | EKKAAGDSH | (SEQ ID NO: 2197) |
| 218 | DPEFRELLS | (SEQ ID NO: 2198) |
| 260 | EFEQLNRNF | (SEQ ID NO: 2199) |
| 24 | LLLLSVLATV | (SEQ ID NO: 2200) |
| 190 | FLDPRPLTVV | (SEQ ID NO: 2201) |
| 88 | RLGSCPIVVL | (SEQ ID NO: 2202) |
| 17 | SIQQTTLLLL | (SEQ ID NO: 2203) |
| 527 | ELLDSAVQNL | (SEQ ID NO: 2204) |
| 413 | HIPKDTVVFV | (SEQ ID NO: 2205) |
| 343 | LLLFTRYPDV | (SEQ ID NO: 2206) |
| 26 | LLSVLATVHV | (SEQ ID NO: 2207) |
| 23 | LLLLLSVLAT | (SEQ ID NO: 2208) |
| 4 | SLSPNDPWPL | (SEQ ID NO: 2209) |
| 336 | STALQWLLLL | (SEQ ID NO: 2210) |
| 456 | LTSRVMIFSV | (SEQ ID NO: 2211) |
| 326 | DIFGASQDTL | (SEQ ID NO: 2212) |
| 195 | PLTVVAVANV | (SEQ ID NO: 2213) |
| 498 | NEPAKMNFSY | (SEQ ID NO: 2214) |
| 445 | FLDKDGLINK | (SEQ ID NO: 2215) |

| | | |
|---|---|---|
| 336 | STALQWLLLL | (SEQ ID NO: 2216) |
| 324 | ITDIFGASQD | (SEQ ID NO: 2217) |
| 218 | DPEFRELLSH | (SEQ ID NO: 2218) |
| 215 | SHDDPEFREL | (SEQ ID NO: 2219) |
| 90 | GSCPIVVLNG | (SEQ ID NO: 2220) |
| 497 | PNEPAKMNFS | (SEQ ID NO: 2221) |
| 428 | NHDPLKWPNP | (SEQ ID NO: 2222) |
| 331 | SQDTLSTALQ | (SEQ ID NO: 2223) |
| 233 | RTVGAGSLVD | (SEQ ID NO: 2224) |
| 171 | LSEARELVAL | (SEQ ID NO: 2225) |
| 114 | FADRPAFASF | (SEQ ID NO: 2226) |
| 81 | YGDVFQIRLG | (SEQ ID NO: 2227) |
| 7 | PNDPWPLNPL | (SEQ ID NO: 2228) |
| 528 | LLDSAVQNLQ | (SEQ ID NO: 2229) |
| 525 | SMELLDSAVQ | (SEQ ID NO: 2230) |
| 475 | LSKMQLFLFI | (SEQ ID NO: 2231) |
| 415 | PKDTVVFVNQ | (SEQ ID NO: 2232) |
| 385 | LYEAMRFSSF | (SEQ ID NO: 2233) |
| 349 | YPDVQTRVQA | (SEQ ID NO: 2234) |
| 185 | SADGAFLDPR | (SEQ ID NO: 2235) |
| 184 | GSADGAFLDP | (SEQ ID NO: 2236) |
| 165 | VLEGHVLSEA | (SEQ ID NO: 2237) |
| 472 | GEELSKMQLF | (SEQ ID NO: 2238) |
| 453 | NKDLTSRVMI | (SEQ ID NO: 2239) |
| 447 | DKDGLINKDL | (SEQ ID NO: 2240) |
| 425 | WSVNHDPLKW | (SEQ ID NO: 2241) |
| 359 | ELDQVVGRDR | (SEQ ID NO: 2242) |
| 353 | QTRVQAELDQ | (SEQ ID NO: 2243) |
| 335 | LSTALQWLLL | (SEQ ID NO: 2244) |
| 314 | RLDLENVPAT | (SEQ ID NO: 2245) |
| 305 | AGDSHGGGAR | (SEQ ID NO: 2246) |
| 299 | SAEKKAAGDS | (SEQ ID NO: 2247) |
| 272 | ILDKFLRHCE | (SEQ ID NO: 2248) |
| 227 | HNEEFGRTVG | (SEQ ID NO: 2249) |
| 20 | QTTLLLLLSV | (SEQ ID NO: 2250) |
| 16 | LSIQQTTLLL | (SEQ ID NO: 2251) |
| 490 | QCDFRANPNE | (SEQ ID NO: 2252) |
| 397 | VTIPHATTAN | (SEQ ID NO: 2253) |
| 357 | QAELDQVVGR | (SEQ ID NO: 2254) |
| 316 | DLENVPATIT | (SEQ ID NO: 2255) |
| 260 | EFEQLNRNFS | (SEQ ID NO: 2256) |
| 258 | FREFEQLNRN | (SEQ ID NO: 2257) |
| 221 | FRELLSHNEE | (SEQ ID NO: 2258) |
| 471 | IGEELSKMQL | (SEQ ID NO: 2259) |
| 436 | NPENFDPARF | (SEQ ID NO: 2260) |
| 392 | SSFVPVTIPH | (SEQ ID NO: 2261) |
| 372 | MGDQPNLPYV | (SEQ ID NO: 2262) |
| 365 | GRDRLPCMGD | (SEQ ID NO: 2263) |
| 322 | ATLTDLFGAS | (SEQ ID NO: 2264) |
| 308 | SHGGGARLDL | (SEQ ID NO: 2265) |
| 292 | MMDAFILSAE | (SEQ ID NO: 2266) |
| 289 | PRDMMDAFIL | (SEQ ID NO: 2267) |
| 273 | LDKFLRHCE | (SEQ ID NO: 2268) |
| 262 | EQLNRNFSN | (SEQ ID NO: 2269) |
| 259 | REFEQLNRN | (SEQ ID NO: 2270) |
| 255 | RTVFREFEQ | (SEQ ID NO: 2271) |
| 243 | VMPWLQYFP | (SEQ ID NO: 2272) |
| 240 | LVDVMPWLQ | (SEQ ID NO: 2273) |
| 222 | RELLSHNEE | (SEQ ID NO: 2274) |
| 214 | YSHDDPEFR | (SEQ ID NO: 2275) |
| 212 | CRYSHDDPE | (SEQ ID NO: 2276) |
| 209 | CFGCRYSHD | (SEQ ID NO: 2277) |
| 206 | SAVCFGCRY | (SEQ ID NO: 2278) |
| 184 | GSADGAFLD | (SEQ ID NO: 2279) |
| 180 | LLVRGSADG | (SEQ ID NO: 2280) |
| 168 | GHVLSEARE | (SEQ ID NO: 2281) |
| 154 | NFFTRQPRS | (SEQ ID NO: 2282) |
| 152 | MRNFFTRQP | (SEQ ID NO: 2283) |
| 138 | SEHWKVQRR | (SEQ ID NO: 2284) |
| 131 | SMAFGHYSE | (SEQ ID NO: 2285) |
| 123 | FRVVSGGRS | (SEQ ID NO: 2286) |
| 104 | HQALVQQGS | (SEQ ID NO: 2287) |
| 97 | LNGERAIHQ | (SEQ ID NO: 2288) |
| 85 | FQIRLGSCP | (SEQ ID NO: 2289) |
| 73 | SFARLARRY | (SEQ ID NO: 2290) |
| 40 | LRQRRRQLR | (SEQ ID NO: 2291) |
| 30 | LATVHVGQR | (SEQ ID NO: 2292) |
| 12 | PLNPLSIQQ | (SEQ ID NO: 2293) |
| 1 | MGTSLSPND | (SEQ ID NO: 2294) |
| 50 | APPGPFAWPL | (SEQ ID NO: 2295) |
| 192 | DPRPLTVVAV | (SEQ ID NO: 2296) |
| 288 | APRDMMDAFI | (SEQ ID NO: 2297) |
| 369 | LPCMGDQPNL | (SEQ ID NO: 2298) |
| 14 | NPLSIQQTTL | (SEQ ID NO: 2299) |
| 375 | QPNLPYVLAF | (SEQ ID NO: 2300) |
| 349 | YPDVQTRVQA | (SEQ ID NO: 2301) |
| 284 | RPGAAPRDMM | (SEQ ID NO: 2302) |
| 117 | RPAFASFRVV | (SEQ ID NO: 2303) |
| 512 | KPKSFKVNVT | (SEQ ID NO: 2304) |
| 434 | WPNPENFDPA | (SEQ ID NO: 2305) |
| 51 | PPGPFAWPLI | (SEQ ID NO: 2306) |
| 9 | DPWPLNPLSI | (SEQ ID NO: 2307) |
| 57 | WPLIGNAAAV | (SEQ ID NO: 2308) |
| 436 | NPENFDPARF | (SEQ ID NO: 2309) |
| 395 | VPVTIPHATT | (SEQ ID NO: 2310) |
| 252 | NPVRTVFREF | (SEQ ID NO: 2311) |
| 496 | NPNEPAKMNF | (SEQ ID NO: 2312) |
| 308 | SHGGGARLDL | (SEQ ID NO: 2313) |
| 250 | FPNPVRTVFR | (SEQ ID NO: 2314) |
| 159 | QPRSRQVLEG | (SEQ ID NO: 2315) |
| 88 | RLGSCPIVVL | (SEQ ID NO: 2316) |
| 513 | PKSFKVNVTL | (SEQ ID NO: 2317) |
| 279 | HCESLRPGA | (SEQ ID NO: 2318) |
| 261 | FEQLNRNFS | (SEQ ID NO: 2319) |
| 231 | FGRTVGAGS | (SEQ ID NO: 2320) |
| 227 | HNEEFGRTV | (SEQ ID NO: 2321) |
| 198 | VVAVANVMS | (SEQ ID NO: 2322) |
| 171 | LSEARELVA | (SEQ ID NO: 2323) |
| 136 | HYSEHWKVQ | (SEQ ID NO: 2324) |
| 133 | AFGHYSEHW | (SEQ ID NO: 2325) |
| 127 | SGGRSMAFG | (SEQ ID NO: 2326) |
| 114 | FADRPAFAS | (SEQ ID NO: 2327) |
| 113 | AFADRPAFA | (SEQ ID NO: 2328) |
| 84 | VFQIRLGSC | (SEQ ID NO: 2329) |
| 29 | VLATVHVGQ | (SEQ ID NO: 2330) |
| 6 | SPNDPWPLN | (SEQ ID NO: 2331) |
| 500 | PAKMNFSYG | (SEQ ID NO: 2332) |
| 488 | AHQCDFRAN | (SEQ ID NO: 2333) |
| 465 | VGKRRCIGE | (SEQ ID NO: 2334) |
| 439 | NFDPARFLD | (SEQ ID NO: 2335) |
| 435 | PNPENFDPA | (SEQ ID NO: 2336) |
| 385 | LYEAMRFSS | (SEQ ID NO: 2337) |
| 371 | CMGDQPNLP | (SEQ ID NO: 2338) |
| 363 | VVGRDRLPC | (SEQ ID NO: 2339) |
| 353 | QTRVQAELD | (SEQ ID NO: 2340) |
| 351 | DVQTRVQAE | (SEQ ID NO: 2341) |
| 349 | YPDVQTRVQ | (SEQ ID NO: 2342) |
| 345 | LFTRYPDVQ | (SEQ ID NO: 2343) |
| 323 | TITDIFGAS | (SEQ ID NO: 2344) |
| 305 | AGDSHGGGA | (SEQ ID NO: 2345) |
| 291 | DMMDAFILS | (SEQ ID NO: 2346) |
| 280 | CESLRPGAA | (SEQ ID NO: 2347) |
| 273 | LDKFLRHCE | (SEQ ID NO: 2348) |
| 257 | VFREFEQLN | (SEQ ID NO: 2349) |
| 246 | WLQYFPNPV | (SEQ ID NO: 2350) |
| 244 | MPWLQYFPN | (SEQ ID NO: 2351) |
| 240 | LVDVMPWLQ | (SEQ ID NO: 2352) |
| 230 | EFGRTVGAG | (SEQ ID NO: 2353) |
| 218 | DPEFRELLS | (SEQ ID NO: 2354) |
| 210 | FGCRYSHDD | (SEQ ID NO: 2355) |
| 209 | CEGCRYSHD | (SEQ ID NO: 2356) |
| 204 | VMSAVCFGC | (SEQ ID NO: 2357) |
| 203 | NVMSAVCFG | (SEQ ID NO: 2358) |
| 170 | VLSEARELV | (SEQ ID NO: 2359) |
| 149 | HSMMRNFFT | (SEQ ID NO: 2360) |
| 74 | FARLARRYG | (SEQ ID NO: 2361) |
| 62 | NAAAVGQAA | (SEQ ID NO: 2362) |
| 46 | QLRSAPPGP | (SEQ ID NO: 2363) |
| 159 | QPRSRQVL | (SEQ ID NO: 2364) |
| 521 | TLRESMEL | (SEQ ID NO: 2365) |
| 510 | TIKPKSFK | (SEQ ID NO: 2366) |
| 218 | DPEFRELL | (SEQ ID NO: 2367) |
| 165 | VLEGHVLSEA | (SEQ ID NO: 2368) |
| 38 | RLLRQRRRQL | (SEQ ID NO: 2369) |
| 451 | LINKDLTSRV | (SEQ ID NO: 2370) |
| 388 | AMRFSSFVPV | (SEQ ID NO: 2371) |
| 338 | ALQWLLLLFT | (SEQ ID NO: 2372) |
| 509 | LTIKPKSFKV | (SEQ ID NO: 2373) |

| | | |
|---|---|---|
| 502 | KMNFSYGLTI | (SEQ ID NO: 2374) |
| 334 | TLSTALQWLL | (SEQ ID NO: 2375) |
| 314 | RLDLENVPAT | (SEQ ID NO: 2376) |
| 291 | DMMDAFILSA | (SEQ ID NO: 2377) |
| 263 | QLNRNFSNFI | (SEQ ID NO: 2378) |
| 234 | TVGAGSLVDV | (SEQ ID NO: 2379) |
| 172 | SEARELVALL | (SEQ ID NO: 2380) |
| 63 | AAAVGQAAHL | (SEQ ID NO: 2381) |
| 21 | TTLLLLLSVL | (SEQ ID NO: 2382) |
| 20 | QTTLLLLLSV | (SEQ ID NO: 2383) |
| 477 | KMQLFLFLSI | (SEQ ID NO: 2384) |
| 450 | GLINKDLTSR | (SEQ ID NO: 2385) |
| 333 | DTLSTALQWL | (SEQ ID NO: 2386) |
| 248 | QYFPNPVRTV | (SEQ ID NO: 2387) |
| 86 | QLRLGSCPLV | (SEQ ID NO: 2388) |
| 486 | ILAHQCDFRA | (SEQ ID NO: 2389) |
| 481 | FLFLSLLAHQ | (SEQ ID NO: 2390) |
| 315 | LDLENVPATI | (SEQ ID NO: 2391) |
| 192 | DPRPLTVVAV | (SEQ ID NO: 2392) |
| 189 | AFLDPRPLTV | (SEQ ID NO: 2393) |
| 171 | LSEARELVAL | (SEQ ID NO: 2394) |
| 170 | VLSEARELVA | (SEQ ID NO: 2395) |
| 106 | ALVQQGSAFA | (SEQ ID NO: 2396) |
| 68 | QAAHLSFARL | (SEQ ID NO: 2397) |
| 22 | TLLLLLSVLA | (SEQ ID NO: 2398) |
| 12 | PLNPLSIQQT | (SEQ ID NO: 2399) |
| 520 | VTLRESMELL | (SEQ ID NO: 2400) |
| 408 | SVLGYHIPKD | (SEQ ID NO: 2401) |
| 376 | PNLPYVLAFL | (SEQ ID NO: 2402) |
| 351 | DVQTRVQAEL | (SEQ ID NO: 2403) |
| 311 | GGARLDLENV | (SEQ ID NO: 2404) |
| 226 | SHNEEFGRTV | (SEQ ID NO: 2405) |
| 198 | VVAVANVMSA | (SEQ ID NO: 2406) |
| 180 | LLVRGSADGA | (SEQ ID NO: 2407) |
| 29 | VLATVHVGQR | (SEQ ID NO: 2408) |
| 18 | IQQTTLLLLL | (SEQ ID NO: 2409) |
| 15 | PLSIQQTTLL | (SEQ ID NO: 2410) |
| 384 | FLYEAMRFSS | (SEQ ID NO: 2411) |
| 199 | VAVANVMSAV | (SEQ ID NO: 2412) |
| 179 | ALLVRGSADG | (SEQ ID NO: 2413) |
| 169 | HVLSEARELV | (SEQ ID NO: 2414) |
| 87 | IRLGSCPIVV | (SEQ ID NO: 2415) |
| 31 | ATVHVGQRLL | (SEQ ID NO: 2416) |
| 279 | HCESLRPGAA | (SEQ ID NO: 2417) |
| 228 | NEEFGRTVGA | (SEQ ID NO: 2418) |
| 98 | NGERAIHQAL | (SEQ ID NO: 2419) |
| 17 | SIQQTTLLLL | (SEQ ID NO: 2420) |
| 9 | DPWPLNPLSI | (SEQ ID NO: 2421) |
| 521 | TLRESMELLD | (SEQ ID NO: 2422) |
| 520 | VTLRESMELL | (SEQ ID NO: 2423) |
| 402 | ATTANTSVLG | (SEQ ID NO: 2424) |
| 378 | LPYVLAFLYE | (SEQ ID NO: 2425) |
| 290 | RDMMDAFILS | (SEQ ID NO: 2426) |
| 270 | NFILDKFLRH | (SEQ ID NO: 2427) |
| 265 | NRNFSNFILD | (SEQ ID NO: 2428) |
| 255 | RTVFREFEQL | (SEQ ID NO: 2429) |
| 170 | VLSEARELVA | (SEQ ID NO: 2430) |
| 49 | SAPPGPFAWP | (SEQ ID NO: 2431) |
| 32 | TVHVGQRLLR | (SEQ ID NO: 2432) |
| 31 | ATVHVGQRLL | (SEQ ID NO: 2433) |
| 515 | SFKVNVTLRE | (SEQ ID NO: 2434) |
| 510 | TIKPKSFKVN | (SEQ ID NO: 2435) |
| 509 | LTIKPKSFKV | (SEQ ID NO: 2436) |
| 457 | TSRVMIFSVG | (SEQ ID NO: 2437) |
| 407 | TSVLGYHIPK | (SEQ ID NO: 2438) |
| 362 | QVVGRDRLPC | (SEQ ID NO: 2439) |
| 346 | FTRYPDVQTR | (SEQ ID NO: 2440) |
| 338 | ALQWLLLLFT | (SEQ ID NO: 2441) |
| 337 | TALQWLLLLF | (SEQ ID NO: 2442) |
| 276 | FLRHCESLRP | (SEQ ID NO: 2443) |
| 217 | DDPEFRELLS | (SEQ ID NO: 2444) |
| 173 | EARELVALLV | (SEQ ID NO: 2445) |
| 70 | AHLSFARLAR | (SEQ ID NO: 2446) |
| 48 | RSAPPGPFAW | (SEQ ID NO: 2447) |
| 33 | VHVGQRLLRQ | (SEQ ID NO: 2448) |
| 23 | LLLLLSVLAT | (SEQ ID NO: 2449) |
| 19 | QQTTLLLLLS | (SEQ ID NO: 2450) |
| 18 | IQQTTLLLLL | (SEQ ID NO: 2451) |
| 6 | SPNDPWPLNP | (SEQ ID NO: 2452) |
| 529 | LDSAVQNLQA | (SEQ ID NO: 2453) |
| 514 | KSFKVNVTLR | (SEQ ID NO: 2454) |
| 502 | KMNFSYGLTI | (SEQ ID NO: 2455) |
| 479 | QLFLFLSLLA | (SEQ ID NO: 2456) |
| 477 | KMQLFLFLSI | (SEQ ID NO: 2457) |
| 463 | FSVGKRRCIG | (SEQ ID NO: 2458) |
| 444 | RFLDKDGLIN | (SEQ ID NO: 2459) |
| 434 | WPNPENFDPA | (SEQ ID NO: 2460) |
| 417 | DTVVFVNQWS | (SEQ ID NO: 2461) |
| 412 | YHIPKDTVVF | (SEQ ID NO: 2462) |
| 375 | QPNLPYVLAF | (SEQ ID NO: 2463) |
| 328 | FGASQDTLST | (SEQ ID NO: 2464) |
| 307 | DSHGGGARLD | (SEQ ID NO: 2465) |
| 282 | SLRPGAAPRD | (SEQ ID NO: 2466) |
| 499 | EPAKMNFSYG | (SEQ ID NO: 2467) |
| 473 | EELSKMQLFL | (SEQ ID NO: 2468) |
| 388 | AMRFSSFVPV | (SEQ ID NO: 2469) |
| 330 | ASQDTLSTAL | (SEQ ID NO: 2470) |
| 194 | RPLTVVAVAN | (SEQ ID NO: 2471) |
| 171 | LSEARELVAL | (SEQ ID NO: 2472) |
| 63 | AAAVGQAAHL | (SEQ ID NO: 2473) |
| 15 | PLSIQQTTLL | (SEQ ID NO: 2474) |
| 4 | SLSPNDPWPL | (SEQ ID NO: 2475) |
| 447 | DKDGLINKDL | (SEQ ID NO: 2476) |
| 414 | IPKDTVVFVN | (SEQ ID NO: 2477) |
| 378 | LPYVLAFLYE | (SEQ ID NO: 2478) |
| 376 | PNLPYVLAFL | (SEQ ID NO: 2479) |
| 336 | STALQWLLLL | (SEQ ID NO: 2480) |
| 335 | LSTALQWLLL | (SEQ ID NO: 2481) |
| 306 | GDSHGGGARL | (SEQ ID NO: 2482) |
| 216 | HDDPEFRELL | (SEQ ID NO: 2483) |
| 182 | VRGSADGAFL | (SEQ ID NO: 2484) |
| 172 | SEARELVALL | (SEQ ID NO: 2485) |
| 157 | TRQPRSRQVL | (SEQ ID NO: 2486) |
| 68 | QAAHLSFARL | (SEQ ID NO: 2487) |
| 18 | IQQTTLLLLL | (SEQ ID NO: 2488) |
| 16 | LSIQQTTLLL | (SEQ ID NO: 2489) |
| 7 | PNDPWPLNPL | (SEQ ID NO: 2490) |
| 527 | ELLDSAVQNL | (SEQ ID NO: 2491) |
| 466 | GKRRCIGEEL | (SEQ ID NO: 2492) |
| 442 | PARFLDKDGL | (SEQ ID NO: 2493) |
| 430 | DPLKWPNPEN | (SEQ ID NO: 2494) |
| 401 | HATTANTSVL | (SEQ ID NO: 2495) |
| 399 | IPHATTANTS | (SEQ ID NO: 2496) |
| 373 | GDQPNLPYVL | (SEQ ID NO: 2497) |
| 334 | TLSTALQWLL | (SEQ ID NO: 2498) |
| 326 | DIFGASQDTL | (SEQ ID NO: 2499) |
| 320 | VPATLTDLFG | (SEQ ID NO: 2500) |
| 264 | LNRNFSNFIL | (SEQ ID NO: 2501) |
| 255 | RTVFREFEQL | (SEQ ID NO: 2502) |
| 244 | MPWLQYFPNP | (SEQ ID NO: 2503) |
| 231 | FGRTVGAGSL | (SEQ ID NO: 2504) |
| 218 | DPEFRELLSH | (SEQ ID NO: 2505) |
| 215 | SHDDPEFREL | (SEQ ID NO: 2506) |
| 187 | DGAFLDPRPL | (SEQ ID NO: 2507) |
| 80 | RYGDVFQIRL | (SEQ ID NO: 2508) |
| 38 | RLLRQRRRQL | (SEQ ID NO: 2509) |
| 31 | ATVHVGQRLL | (SEQ ID NO: 2510) |
| 17 | SIQQTTLLLL | (SEQ ID NO: 2511) |
| 6 | SPNDPWPLNP | (SEQ ID NO: 2512) |
| 529 | LDSAVQNLQA | (SEQ ID NO: 2513) |
| 471 | IGEELSKMQL | (SEQ ID NO: 2514) |
| 441 | DPARFLDKDG | (SEQ ID NO: 2515) |
| 437 | PENFDPARFL | (SEQ ID NO: 2516) |
| 173 | EARELVAL | (SEQ ID NO: 2517) |
| 515 | SFKVNVTL | (SEQ ID NO: 2518) |
| 414 | IPKDTVVF | (SEQ ID NO: 2519) |
| 276 | FLRHCESL | (SEQ ID NO: 2520) |
| 473 | EELSKMQL | (SEQ ID NO: 2521) |
| 475 | LSKMQLFL | (SEQ ID NO: 2522) |
| 455 | DLTSRVMI | (SEQ ID NO: 2523) |
| 444 | RFLDKDGL | (SEQ ID NO: 2524) |
| 39 | LLRQRRRQ | (SEQ ID NO: 2525) |
| 465 | VGKRRCIG | (SEQ ID NO: 2526) |
| 310 | GGGARLDL | (SEQ ID NO: 2527) |
| 257 | VFREFEQL | (SEQ ID NO: 2528) |
| 170 | VLSEAREL | (SEQ ID NO: 2529) |
| 362 | QVVGRDRL | (SEQ ID NO: 2530) |
| 40 | LRQRRRQL | (SEQ ID NO: 2531) |

-continued

| | | |
|---|---|---|
| 6 | SPNDPWPL | (SEQ ID NO: 2532) |
| 508 | GLTIKPKS | (SEQ ID NO: 2533) |
| 450 | GLINKDLT | (SEQ ID NO: 2534) |
| 378 | LPYVLAFL | (SEQ ID NO: 2535) |
| 375 | QPNLPYVL | (SEQ ID NO: 2536) |
| 353 | QTRVQAEL | (SEQ ID NO: 2537) |
| 23 | LLLLLSVL | (SEQ ID NO: 2538) |
| 535 | NLQAKETC | (SEQ ID NO: 2539) |
| 512 | KPKSFKVN | (SEQ ID NO: 2540) |
| 498 | NEPAKMNF | (SEQ ID NO: 2541) |
| 464 | SVGKRRCI | (SEQ ID NO: 2542) |
| 431 | PLKWPNPE | (SEQ ID NO: 2543) |
| 338 | ALQWLLLL | (SEQ ID NO: 2544) |
| 299 | SAEKKAAG | (SEQ ID NO: 2545) |
| 17 | SIQQTTLL | (SEQ ID NO: 2546) |
| 9 | DPWPLNPL | (SEQ ID NO: 2547) |
| 384 | FLYEAMRF | (SEQ ID NO: 2548) |
| 364 | VGRDRLPC | (SEQ ID NO: 2549) |
| 271 | FILDKFLR | (SEQ ID NO: 2550) |
| 251 | PNPVRTVF | (SEQ ID NO: 2551) |
| 190 | FLDPRPLT | (SEQ ID NO: 2552) |
| 179 | ALLVRGSA | (SEQ ID NO: 2553) |
| 149 | HSMMRNFF | (SEQ ID NO: 2554) |
| 500 | PAKMNFSY | (SEQ ID NO: 2555) |
| 474 | ELSKMQLF | (SEQ ID NO: 2556) |
| 344 | LLFTRYPD | (SEQ ID NO: 2557) |
| 337 | TALQWLLL | (SEQ ID NO: 2558) |
| 282 | SLRPGAAP | (SEQ ID NO: 2559) |
| 113 | AFADRPAF | (SEQ ID NO: 2560) |
| 76 | RLARRYGD | (SEQ ID NO: 2561) |
| 41 | RQRRRQLR | (SEQ ID NO: 2562) |
| 486 | ILAHQCDF | (SEQ ID NO: 2563) |
| 479 | QLFLFLSI | (SEQ ID NO: 2564) |
| 445 | FLDKDGLI | (SEQ ID NO: 2565) |
| 377 | NLPYVLAF | (SEQ ID NO: 2566) |
| 519 | NVTLRESMEL | (SEQ ID NO: 2567) |
| 494 | RANPNEPAKM | (SEQ ID NO: 2568) |
| 479 | QLFLFISILA | (SEQ ID NO: 2569) |
| 478 | MQLFLFLSLL | (SEQ ID NO: 2570) |
| 445 | FLDKDGLINK | (SEQ ID NO: 2571) |
| 418 | TVVFVNQWSV | (SEQ ID NO: 2572) |
| 410 | LGYHIPKDTV | (SEQ ID NO: 2573) |
| 372 | MGDQPNLPYV | (SEQ ID NO: 2574) |
| 342 | LLLLFTRYPD | (SEQ ID NO: 2575) |
| 329 | GASQDTLSTA | (SEQ ID NO: 2576) |
| 308 | SHGGGARLDL | (SEQ ID NO: 2577) |
| 297 | ILSAEKKAAG | (SEQ ID NO: 2578) |
| 296 | FILSAEKKAA | (SEQ ID NO: 2579) |
| 282 | SLRPGAAPRD | (SEQ ID NO: 2580) |
| 215 | SHDDPEFREL | (SEQ ID NO: 2581) |
| 164 | QVLEGHVLSE | (SEQ ID NO: 2582) |
| 156 | FTRQPRSRQV | (SEQ ID NO: 2583) |
| 94 | IVVLNGERAI | (SEQ ID NO: 2584) |
| 71 | HLSFARLARR | (SEQ ID NO: 2585) |
| 57 | WPLIGNAAAV | (SEQ ID NO: 2586) |
| 30 | LATVHVGQRL | (SEQ ID NO: 2587) |
| 16 | LSIQQTTLLL | (SEQ ID NO: 2588) |
| 511 | IKPKSFKVNV | (SEQ ID NO: 2589) |
| 469 | RCIGEELSKM | (SEQ ID NO: 2590) |
| 398 | TIPHATTANT | (SEQ ID NO: 2591) |
| 386 | YEAMRFSSFV | (SEQ ID NO: 2592) |
| 381 | VLAFLYEAMR | (SEQ ID NO: 2593) |
| 373 | GDQPNLPYVL | (SEQ ID NO: 2594) |
| 363 | VVGRDRLPCM | (SEQ ID NO: 2595) |
| 355 | RVQAELDQVV | (SEQ ID NO: 2596) |
| 354 | TRVQAELDQV | (SEQ ID NO: 2597) |
| 330 | ASQDTLSTAL | (SEQ ID NO: 2598) |
| 238 | GSLVDVMPWL | (SEQ ID NO: 2599) |
| 177 | LVALLVRGSA | (SEQ ID NO: 2600) |
| 173 | EARELVALLV | (SEQ ID NO: 2601) |
| 102 | AIHQALVQQG | (SEQ ID NO: 2602) |
| 96 | VLNGERAIHQ | (SEQ ID NO: 2603) |
| 75 | ARLARRYGDV | (SEQ ID NO: 2604) |
| 55 | FAWPLIGNAA | (SEQ ID NO: 2605) |
| 50 | APPGPFAWPL | (SEQ ID NO: 2606) |
| 25 | LLSVLATVH | (SEQ ID NO: 2607) |
| 14 | NPLSIQQTTL | (SEQ ID NO: 2608) |
| 7 | PNDPWPLNPL | (SEQ ID NO: 2609) |
| 528 | LLDSAVQNLQ | (SEQ ID NO: 2610) |
| 521 | TLRESMELLD | (SEQ ID NO: 2611) |
| 471 | IGEELSKMQL | (SEQ ID NO: 2612) |
| 466 | GKRRCIGEEL | (SEQ ID NO: 2613) |
| 409 | VLGYHIPKDT | (SEQ ID NO: 2614) |
| 257 | VFREFEQLNR | (SEQ ID NO: 2615) |
| 225 | LSHNEEFGRT | (SEQ ID NO: 2616) |
| 196 | LTVVAVANVM | (SEQ ID NO: 2617) |
| 189 | AFLDPRPLTV | (SEQ ID NO: 2618) |
| 164 | QVLEGHVLSE | (SEQ ID NO: 2619) |
| 159 | QPRSRQVLEG | (SEQ ID NO: 2620) |
| 156 | FTRQPRSRQV | (SEQ ID NO: 2621) |
| 149 | HSMMRNFFTR | (SEQ ID NO: 2622) |
| 100 | ERAIHQALVQ | (SEQ ID NO: 2623) |
| 96 | VLNGERAIHQ | (SEQ ID NO: 2624) |
| 82 | GDVFQIRLGS | (SEQ ID NO: 2625) |
| 65 | AVGQAAHLSF | (SEQ ID NO: 2626) |
| 21 | TTLLLLLSVL | (SEQ ID NO: 2627) |
| 4 | SLSPNDPWPL | (SEQ ID NO: 2628) |
| 2 | GTSLSPNDPW | (SEQ ID NO: 2629) |
| 505 | FSYGLTIKPK | (SEQ ID NO: 2630) |
| 504 | NFSYGLTIKP | (SEQ ID NO: 2631) |
| 494 | RANPNEPAKM | (SEQ ID NO: 2632) |
| 480 | LFLFISILAH | (SEQ ID NO: 2633) |
| 473 | EELSKMQLFL | (SEQ ID NO: 2634) |
| 468 | RRCIGEELSK | (SEQ ID NO: 2635) |
| 464 | SVGKRRCIGE | (SEQ ID NO: 2636) |
| 456 | LTSRVMIFSV | (SEQ ID NO: 2637) |
| 449 | DGLINKDLTS | (SEQ ID NO: 2638) |
| 406 | NTSVLGYHIP | (SEQ ID NO: 2639) |
| 393 | SFVPVTIPHA | (SEQ ID NO: 2640) |
| 391 | FSSFVPVTIP | (SEQ ID NO: 2641) |
| 333 | DTLSTALQWL | (SEQ ID NO: 2642) |
| 332 | QDTLSTALQW | (SEQ ID NO: 2643) |
| 310 | GGGARLDLEN | (SEQ ID NO: 2644) |
| 291 | DMMDAFILSA | (SEQ ID NO: 2645) |
| 266 | RNFSNFILDK | (SEQ ID NO: 2646) |
| 214 | YSHDDPEFRE | (SEQ ID NO: 2647) |
| 157 | TRQPRSRQVL | (SEQ ID NO: 2648) |
| 126 | VSGGRSMAFG | (SEQ ID NO: 2649) |
| 87 | IRLGSCPIVV | (SEQ ID NO: 2650) |
| 55 | FAWPLIGNAA | (SEQ ID NO: 2651) |
| 52 | PGPFAWPLIG | (SEQ ID NO: 2652) |
| 51 | PPGPFAWPLI | (SEQ ID NO: 2653) |
| 40 | LRQRRRQLRS | (SEQ ID NO: 2654) |
| 27 | LSVLATVHVG | (SEQ ID NO: 2655) |
| 5 | LSPNDPWPLN | (SEQ ID NO: 2656) |
| 455 | DLTSRVMIFS | (SEQ ID NO: 2657) |
| 408 | SVLGYHIPKD | (SEQ ID NO: 2658) |
| 373 | GDQPNLPYVL | (SEQ ID NO: 2659) |
| 367 | DRLPCMGDQP | (SEQ ID NO: 2660) |
| 330 | ASQDTLSTAL | (SEQ ID NO: 2661) |
| 423 | NQWSVNHDPL | (SEQ ID NO: 2662) |
| 413 | HIPKDTVVFV | (SEQ ID NO: 2663) |
| 412 | YHIPKDTVVF | (SEQ ID NO: 2664) |
| 390 | RFSSFVPVTI | (SEQ ID NO: 2665) |
| 360 | LDQVVGRDRL | (SEQ ID NO: 2666) |
| 351 | DVQTRVQAEL | (SEQ ID NO: 2667) |
| 338 | ALQWLLLLFT | (SEQ ID NO: 2668) |
| 314 | RLDLENVPAT | (SEQ ID NO: 2669) |
| 313 | ARLDLENVPA | (SEQ ID NO: 2670) |
| 289 | PRDMMDAFIL | (SEQ ID NO: 2671) |
| 268 | FSNFILDKFL | (SEQ ID NO: 2672) |
| 238 | GSLVDVMPWL | (SEQ ID NO: 2673) |
| 235 | VGAGSLVDVM | (SEQ ID NO: 2674) |
| 181 | LVRGSADGAF | (SEQ ID NO: 2675) |
| 173 | EARELVALLV | (SEQ ID NO: 2676) |
| 170 | VLSEARELVA | (SEQ ID NO: 2677) |
| 162 | SRQVLEGHVL | (SEQ ID NO: 2678) |
| 148 | AHSMMRNFFT | (SEQ ID NO: 2679) |
| 125 | VVSGGRSMAF | (SEQ ID NO: 2680) |
| 98 | NGERAIHQAL | (SEQ ID NO: 2681) |
| 78 | ARRYGDVFQI | (SEQ ID NO: 2682) |
| 65 | AVGQAAHLSF | (SEQ ID NO: 2683) |
| 53 | GPFAWPLIGN | (SEQ ID NO: 2684) |
| 47 | LRSAPPGPFA | (SEQ ID NO: 2685) |
| 26 | LLSVLATVHV | (SEQ ID NO: 2686) |
| 21 | TTLLLLLSVL | (SEQ ID NO: 2687) |
| 520 | VTLRESMELL | (SEQ ID NO: 2688) |
| 519 | NVTLRESMEL | (SEQ ID NO: 2689) |

-continued

| | | |
|---|---|---|
| 511 | IKPKSFKVNV | (SEQ ID NO: 2690) |
| 500 | PAKMNFSYGL | (SEQ ID NO: 2691) |
| 492 | DFRANPNEPA | (SEQ ID NO: 2692) |
| 478 | MQLFLFLSLL | (SEQ ID NO: 2693) |
| 475 | LSKMQLFLFI | (SEQ ID NO: 2694) |
| 474 | ELSKMQLFLF | (SEQ ID NO: 2695) |
| 462 | IFSVGKRRCI | (SEQ ID NO: 2696) |
| 453 | NKDLTSRVMI | (SEQ ID NO: 2697) |
| 333 | DTLSTALQWL | (SEQ ID NO: 2698) |
| 328 | FGASQDTLST | (SEQ ID NO: 2699) |
| 274 | DKFLRHCESL | (SEQ ID NO: 2700) |
| 234 | TVGAGSLVDV | (SEQ ID NO: 2701) |
| 191 | LDPRPLTVVA | (SEQ ID NO: 2702) |
| 190 | FLDPRPLTVV | (SEQ ID NO: 2703) |
| 189 | AFLDPRPLTV | (SEQ ID NO: 2704) |
| 168 | GHVLSEAREL | (SEQ ID NO: 2705) |
| 147 | AAHSMMRNFF | (SEQ ID NO: 2706) |
| 139 | EHWKVQRRAA | (SEQ ID NO: 2707) |
| 111 | GSAFADRPAF | (SEQ ID NO: 2708) |
| 110 | QGSAFADRPA | (SEQ ID NO: 2709) |
| 336 | STALQWLL | (SEQ ID NO: 2710) |
| 320 | VPATLTDI | (SEQ ID NO: 2711) |
| 286 | GAAPRDMM | (SEQ ID NO: 2712) |
| 120 | FASFRVVS | (SEQ ID NO: 2713) |
| 96 | VLNGERAI | (SEQ ID NO: 2714) |
| 78 | ARRYGDVF | (SEQ ID NO: 2715) |
| 53 | GPFAWPLI | (SEQ ID NO: 2716) |
| 429 | HDPLKWPN | (SEQ ID NO: 2717) |
| 387 | EAMRFSSF | (SEQ ID NO: 2718) |
| 312 | GARLDLEN | (SEQ ID NO: 2719) |
| 308 | SHGGGARL | (SEQ ID NO: 2720) |
| 301 | EKKAAGDS | (SEQ ID NO: 2721) |
| 288 | APRDMMDA | (SEQ ID NO: 2722) |
| 264 | LNRNFSNF | (SEQ ID NO: 2723) |
| 224 | LLSHNEEF | (SEQ ID NO: 2724) |
| 217 | DDPEFREL | (SEQ ID NO: 2725) |
| 192 | DPRPLTVV | (SEQ ID NO: 2726) |
| 164 | QVLEGHVL | (SEQ ID NO: 2727) |
| 140 | HWKVQRRA | (SEQ ID NO: 2728) |
| 138 | SEHWKVQR | (SEQ ID NO: 2729) |
| 100 | ERAIHQAL | (SEQ ID NO: 2730) |
| 74 | FARLARRY | (SEQ ID NO: 2731) |
| 46 | QLRSAPPG | (SEQ ID NO: 2732) |
| 11 | WPLNPLSI | (SEQ ID NO: 2733) |
| 463 | FSVGKRRC | (SEQ ID NO: 2734) |
| 452 | INKDLTSR | (SEQ ID NO: 2735) |
| 332 | QDTLSTAL | (SEQ ID NO: 2736) |
| 328 | FGASQDTL | (SEQ ID NO: 2737) |
| 270 | NFILDKFL | (SEQ ID NO: 2738) |
| 240 | LVDVMPWL | (SEQ ID NO: 2739) |
| 184 | GSADGAFL | (SEQ ID NO: 2740) |
| 174 | ARELVALL | (SEQ ID NO: 2741) |
| 90 | GSCPIVVL | (SEQ ID NO: 2742) |
| 86 | QIRLGSCP | (SEQ ID NO: 2743) |
| 82 | GDVFQIRL | (SEQ ID NO: 2744) |
| 33 | VHVGQRLL | (SEQ ID NO: 2745) |
| 32 | TVHVGQRL | (SEQ ID NO: 2746) |
| 20 | QTTLLLLL | (SEQ ID NO: 2747) |
| 18 | IQQTTLLL | (SEQ ID NO: 2748) |
| 529 | LDSAVQNL | (SEQ ID NO: 2749) |
| 522 | LRESMELL | (SEQ ID NO: 2750) |
| 513 | PKSFKVNV | (SEQ ID NO: 2751) |
| 502 | KMNFSYGL | (SEQ ID NO: 2752) |
| 480 | LFLFLSLL | (SEQ ID NO: 2753) |
| 468 | RRCIGEEL | (SEQ ID NO: 2754) |
| 449 | DGLINKDL | (SEQ ID NO: 2755) |
| 446 | LDKDGLIN | (SEQ ID NO: 2756) |
| 401 | HATTANTSVL | (SEQ ID NO: 2757) |
| 393 | SFVPVTIPHA | (SEQ ID NO: 2758) |
| 380 | YVLAFLYEAM | (SEQ ID NO: 2759) |
| 369 | LPCMGDQPNL | (SEQ ID NO: 2760) |
| 347 | TRYPDVQTRV | (SEQ ID NO: 2761) |
| 344 | LLFTRYPDVQ | (SEQ ID NO: 2762) |
| 306 | GDSHGGGARL | (SEQ ID NO: 2763) |
| 292 | MMDAFILSAE | (SEQ ID NO: 2764) |
| 288 | APRDMMDAFI | (SEQ ID NO: 2765) |
| 286 | GAAPRDMMDA | (SEQ ID NO: 2766) |
| 272 | ILDKFLRHCE | (SEQ ID NO: 2767) |
| 255 | RTVFREFEQL | (SEQ ID NO: 2768) |
| 239 | SLVDVMPWLQ | (SEQ ID NO: 2769) |
| 235 | VGAGSLVDVM | (SEQ ID NO: 2770) |
| 231 | FGRTVGAGSL | (SEQ ID NO: 2771) |
| 224 | LLSHNEEFGR | (SEQ ID NO: 2772) |
| 182 | VRGSADGAFL | (SEQ ID NO: 2773) |
| 168 | GHVLSEAREL | (SEQ ID NO: 2774) |
| 162 | SRQVLEGHVL | (SEQ ID NO: 2775) |
| 131 | SMAFGHYSEH | (SEQ ID NO: 2776) |
| 112 | SAFADRPAFA | (SEQ ID NO: 2777) |
| 99 | GERAIHQALV | (SEQ ID NO: 2778) |
| 97 | LNGERAIHQA | (SEQ ID NO: 2779) |
| 78 | ARRYGDVFQI | (SEQ ID NO: 2780) |
| 59 | LIGNAAAVGQ | (SEQ ID NO: 2781) |
| 58 | PLIGNAAAVG | (SEQ ID NO: 2782) |
| 9 | DPWPLNPLSI | (SEQ ID NO: 2783) |
| 517 | KVNVTLRESM | (SEQ ID NO: 2784) |
| 500 | PAKMNFSYGL | (SEQ ID NO: 2785) |
| 403 | TTANTSVLGY | (SEQ ID NO: 2786) |
| 390 | RFSSFVPVTI | (SEQ ID NO: 2787) |
| 360 | LDQVVGRDRL | (SEQ ID NO: 2788) |
| 341 | WLLLLFTRYP | (SEQ ID NO: 2789) |
| 335 | LSTALQWLLL | (SEQ ID NO: 2790) |
| 323 | TITD1FGASQ | (SEQ ID NO: 2791) |
| 316 | DLENVPATIT | (SEQ ID NO: 2792) |
| 304 | AAGDSHGGGA | (SEQ ID NO: 2793) |
| 276 | FLRHCESLRP | (SEQ ID NO: 2794) |
| 274 | DKFLRHCESL | (SEQ ID NO: 2795) |
| 264 | LNRNFSNFIL | (SEQ ID NO: 2796) |
| 216 | HDDPEFRELL | (SEQ ID NO: 2797) |
| 185 | SADGAFLDPR | (SEQ ID NO: 2798) |
| 176 | ELVALLVRGS | (SEQ ID NO: 2799) |
| 157 | TRQPRSRQVL | (SEQ ID NO: 2800) |
| 142 | KVQRRAAHSM | (SEQ ID NO: 2801) |
| 134 | FGHYSEHWKV | (SEQ ID NO: 2802) |
| 119 | AFASFRVVSG | (SEQ ID NO: 2803) |
| 268 | FSNFLLDKFL | (SEQ ID NO: 2804) |
| 250 | FPNPVRTVFR | (SEQ ID NO: 2805) |
| 248 | QYFPNPVRTV | (SEQ ID NO: 2806) |
| 239 | SLVDVMPWLQ | (SEQ ID NO: 2807) |
| 192 | DPRPLTVVAV | (SEQ ID NO: 2808) |
| 172 | SEARELVALL | (SEQ ID NO: 2809) |
| 150 | SMMRNFFTRQ | (SEQ ID NO: 2810) |
| 121 | ASFRVVSGGR | (SEQ ID NO: 2811) |
| 115 | ADRPAFASFR | (SEQ ID NO: 2812) |
| 111 | GSAFADRPAF | (SEQ ID NO: 2813) |
| 108 | VQQGSAFADR | (SEQ ID NO: 2814) |
| 12 | PLNPLSIQQT | (SEQ ID NO: 2815) |
| 531 | SAVQNLQAKE | (SEQ ID NO: 2816) |
| 530 | DSAVQNLQAK | (SEQ ID NO: 2817) |
| 524 | ESMELLDSAV | (SEQ ID NO: 2818) |
| 506 | SYGLTIKPKS | (SEQ ID NO: 2819) |
| 484 | ISILAHQCDF | (SEQ ID NO: 2820) |
| 432 | LKWPNPENFD | (SEQ ID NO: 2821) |
| 388 | AMRFSSFVPV | (SEQ ID NO: 2822) |
| 376 | PNLPYVLAFL | (SEQ ID NO: 2823) |
| 347 | TRYPDVQTRV | (SEQ ID NO: 2824) |
| 318 | ENVPATITDI | (SEQ ID NO: 2825) |
| 317 | LENVPATITD | (SEQ ID NO: 2826) |
| 298 | LSAEKKAAGD | (SEQ ID NO: 2827) |
| 286 | GAAPRDMMDA | (SEQ ID NO: 2828) |
| 281 | ESLRPGAAPR | (SEQ ID NO: 2829) |
| 269 | SNFILDKFLR | (SEQ ID NO: 2830) |
| 249 | YFPNPVRTVF | (SEQ ID NO: 2831) |
| 242 | DVMPWLQYFP | (SEQ ID NO: 2832) |
| 238 | GSLVDVMPWL | (SEQ ID NO: 2833) |
| 204 | VMSAVCFGCR | (SEQ ID NO: 2834) |
| 162 | SRQVLEGHVL | (SEQ ID NO: 2835) |
| 161 | RSRQVLEGHV | (SEQ ID NO: 2836) |
| 130 | RSMAFGHYSE | (SEQ ID NO: 2837) |
| 117 | RPAFASFRVV | (SEQ ID NO: 2838) |
| 80 | RYGDVFQIRL | (SEQ ID NO: 2839) |
| 106 | ALVQQGSAFA | (SEQ ID NO: 2840) |
| 99 | GERAIHQALV | (SEQ ID NO: 2841) |
| 92 | CPIVVLNGER | (SEQ ID NO: 2842) |
| 87 | IRLGSCPIVV | (SEQ ID NO: 2843) |
| 56 | AWPLIGNAAA | (SEQ ID NO: 2844) |
| 30 | LATVHVGQRL | (SEQ ID NO: 2845) |
| 23 | LLLLLSVLAT | (SEQ ID NO: 2846) |
| 11 | WPLNPLSIQQ | (SEQ ID NO: 2847) |

-continued

| | | |
|---|---|---|
| 524 | ESMELLDSAV | (SEQ ID NO: 2848) |
| 523 | RESMELLDSA | (SEQ ID NO: 2849) |
| 502 | KMNFSYGLTI | (SEQ ID NO: 2850) |
| 501 | AKMNFSYGLT | (SEQ ID NO: 2851) |
| 494 | RANPNEPAKM | (SEQ ID NO: 2852) |
| 469 | RCIGEELSKM | (SEQ ID NO: 2853) |
| 389 | MRFSSFVPVT | (SEQ ID NO: 2854) |
| 355 | RVQAELDQVV | (SEQ ID NO: 2855) |
| 318 | ENVPATITDI | (SEQ ID NO: 2856) |
| 304 | AAGDSHGGGA | (SEQ ID NO: 2857) |
| 291 | DMMDAFILSA | (SEQ ID NO: 2858) |
| 287 | AAPRDMMDAF | (SEQ ID NO: 2859) |
| 278 | RHCESLRPGA | (SEQ ID NO: 2860) |
| 249 | YFPNPVRTVF | (SEQ ID NO: 2861) |
| 228 | NEEFGRTVGA | (SEQ ID NO: 2862) |
| 193 | PRPLTVVAVA | (SEQ ID NO: 2863) |
| 161 | RSRQVLEGHV | (SEQ ID NO: 2864) |
| 114 | FADRPAFASF | (SEQ ID NO: 2865) |
| 112 | SAFADRPAFA | (SEQ ID NO: 2866) |
| 86 | QLRLGSCPLV | (SEQ ID NO: 2867) |
| 76 | RLARRYGDVF | (SEQ ID NO: 2868) |
| 60 | IGNAAAVGQA | (SEQ ID NO: 2869) |
| 46 | QLRSAPPGPF | (SEQ ID NO: 2870) |
| 41 | RQRRRQLRSA | (SEQ ID NO: 2871) |
| 532 | AVQNLQAKET | (SEQ ID NO: 2872) |
| 517 | KVNVTLRESM | (SEQ ID NO: 2873) |
| 486 | ILAHQCDFRA | (SEQ ID NO: 2874) |
| 442 | PARFLDKD | (SEQ ID NO: 2875) |
| 439 | NFDPARFL | (SEQ ID NO: 2876) |
| 425 | WSVNHDPL | (SEQ ID NO: 2877) |
| 412 | YHIPKDTV | (SEQ ID NO: 2878) |
| 403 | TTANTSVL | (SEQ ID NO: 2879) |
| 371 | CMGDQPNL | (SEQ ID NO: 2880) |
| 335 | LSTALQWL | (SEQ ID NO: 2881) |
| 321 | PATLTDLF | (SEQ ID NO: 2882) |
| 300 | AEKKAAGD | (SEQ ID NO: 2883) |
| 291 | DMMDAFIL | (SEQ ID NO: 2884) |
| 273 | LDKFLRHC | (SEQ ID NO: 2885) |
| 266 | RNFSNFLL | (SEQ ID NO: 2886) |
| 262 | EQLNRNFS | (SEQ ID NO: 2887) |
| 233 | RTVGAGSL | (SEQ ID NO: 2888) |
| 229 | EEFGRTVG | (SEQ ID NO: 2889) |
| 220 | EFRELLSH | (SEQ ID NO: 2890) |
| 189 | AFLDPRPL | (SEQ ID NO: 2891) |
| 97 | LNGERAIH | (SEQ ID NO: 2892) |
| 77 | LARRYGDV | (SEQ ID NO: 2893) |
| 70 | AHLSFARL | (SEQ ID NO: 2894) |
| 65 | AVGQAAHL | (SEQ ID NO: 2895) |
| 52 | PGPFAWPL | (SEQ ID NO: 2896) |
| 19 | QQTTLLLL | (SEQ ID NO: 2897) |
| 16 | LSIQQTTL | (SEQ ID NO: 2898) |
| 519 | NVTLRESM | (SEQ ID NO: 2899) |
| 440 | FDPARFLD | (SEQ ID NO: 2900) |
| 392 | SSFVPVTI | (SEQ ID NO: 2901) |
| 280 | CESLRPGA | (SEQ ID NO: 2902) |
| 274 | DKFLRHCE | (SEQ ID NO: 2903) |
| 84 | VFQIRLGS | (SEQ ID NO: 2904) |
| 44 | RRQLRSAP | (SEQ ID NO: 2905) |
| 37 | QRLLRQRR | (SEQ ID NO: 2906) |
| 34 | HVGQRLLR | (SEQ ID NO: 2907) |
| 527 | ELLDSAVQ | (SEQ ID NO: 2908) |
| 499 | EPAKMNFS | (SEQ ID NO: 2909) |
| 79 | RRYGDVFQIR | (SEQ ID NO: 2910) |
| 477 | KMQLFLFISI | (SEQ ID NO: 2911) |
| 64 | AAVGQAAHLS | (SEQ ID NO: 2912) |
| 53 | GPFAWPLIGN | (SEQ ID NO: 2913) |
| 39 | LLRQRRRQLR | (SEQ ID NO: 2914) |
| 11 | WPLNPLSIQQ | (SEQ ID NO: 2915) |
| 3 | TSLSPNDPWP | (SEQ ID NO: 2916) |
| 501 | AKMNFSYGLT | (SEQ ID NO: 2917) |
| 499 | EPAKMNFSYG | (SEQ ID NO: 2918) |
| 487 | LAHQCDFRAN | (SEQ ID NO: 2919) |
| 474 | ELSKMQLFLF | (SEQ ID NO: 2920) |
| 469 | RCIGEELSKM | (SEQ ID NO: 2921) |
| 456 | LTSRVMIFSV | (SEQ ID NO: 2922) |
| 454 | KDLTSRVMIF | (SEQ ID NO: 2923) |
| 452 | INKDLTSRVM | (SEQ ID NO: 2924) |
| 451 | LINKDLTSRV | (SEQ ID NO: 2925) |
| 448 | KDGLINKDLT | (SEQ ID NO: 2926) |

-continued

| | | |
|---|---|---|
| 443 | ARFLDKDGLI | (SEQ ID NO: 2927) |
| 411 | GYHIPKDTVV | (SEQ ID NO: 2928) |
| 405 | ANTSVLGYHI | (SEQ ID NO: 2929) |
| 400 | PHATTANTSV | (SEQ ID NO: 2930) |
| 398 | TIPHATTANT | (SEQ ID NO: 2931) |
| 490 | QCDFRANP | (SEQ ID NO: 2932) |
| 476 | SKMQLFLF | (SEQ ID NO: 2933) |
| 438 | ENFDPARF | (SEQ ID NO: 2934) |
| 409 | VLGYHIPK | (SEQ ID NO: 2935) |
| 386 | YEAMRFSS | (SEQ ID NO: 2936) |
| 359 | ELDQVVGR | (SEQ ID NO: 2937) |
| 351 | DVQTRVQA | (SEQ ID NO: 2938) |
| 346 | FTRYPDVQ | (SEQ ID NO: 2939) |
| 269 | SNFILDKF | (SEQ ID NO: 2940) |
| 261 | FEQLNRNF | (SEQ ID NO: 2941) |
| 101 | RAIHQALVQQ | (SEQ ID NO: 2942) |
| 76 | RLARRYGDVF | (SEQ ID NO: 2943) |
| 39 | LLRQRRRQLR | (SEQ ID NO: 2944) |
| 532 | AVQNLQAKET | (SEQ ID NO: 2945) |
| 525 | SMELLDSAVQ | (SEQ ID NO: 2946) |
| 524 | ESMELLDSAV | (SEQ ID NO: 2947) |
| 474 | ELSKMQLFLF | (SEQ ID NO: 2948) |
| 459 | RVMIFSVGKR | (SEQ ID NO: 2949) |
| 443 | ARFLDKDGLI | (SEQ ID NO: 2950) |
| 442 | PARFLDKDGL | (SEQ ID NO: 2951) |
| 423 | NQWSVNHDPL | (SEQ ID NO: 2952) |
| 421 | FVNQWSVNHD | (SEQ ID NO: 2953) |
| 411 | GYHIPKDTVV | (SEQ ID NO: 2954) |
| 400 | PHATTANTSV | (SEQ ID NO: 2955) |
| 394 | FVPVTIPHAT | (SEQ ID NO: 2956) |
| 337 | TALQWLLLLF | (SEQ ID NO: 2957) |
| 318 | ENVPATLTDI | (SEQ ID NO: 2958) |
| 313 | ARLDLENVPA | (SEQ ID NO: 2959) |
| 196 | LTVVAVANVM | (SEQ ID NO: 2960) |
| 188 | GAFLDPRPLT | (SEQ ID NO: 2961) |
| 150 | SMMRNFFTRQ | (SEQ ID NO: 2962) |
| 117 | RPAFASFRVV | (SEQ ID NO: 2963) |
| 85 | FQLRLGSCPI | (SEQ ID NO: 2964) |
| 80 | RYGDVFQIRL | (SEQ ID NO: 2965) |
| 60 | IGNAAAVGQA | (SEQ ID NO: 2966) |
| 28 | SVLATVHVGQ | (SEQ ID NO: 2967) |
| 531 | SAVQNLQAKE | (SEQ ID NO: 2968) |
| 523 | RESMELLDSA | (SEQ ID NO: 2969) |
| 513 | PKSFKVNVTL | (SEQ ID NO: 2970) |
| 508 | GLTIKPKSFK | (SEQ ID NO: 2971) |
| 475 | LSKMQLFLFI | (SEQ ID NO: 2972) |
| 473 | EELSKMQLFL | (SEQ ID NO: 2973) |
| 462 | IFSVGKRRCI | (SEQ ID NO: 2974) |
| 453 | NKDLTSRVMI | (SEQ ID NO: 2975) |
| 447 | DKDGLLNKDL | (SEQ ID NO: 2976) |
| 426 | SVNHDPLKWP | (SEQ ID NO: 2977) |
| 405 | ANTSVLGYHI | (SEQ ID NO: 2978) |
| 397 | VTIPHATTAN | (SEQ ID NO: 2979) |
| 389 | MRFSSFVPVT | (SEQ ID NO: 2980) |
| 371 | CMGDQPNLPY | (SEQ ID NO: 2981) |
| 368 | RLPCMGDQPN | (SEQ ID NO: 2982) |
| 357 | QAELDQVVGR | (SEQ ID NO: 2983) |
| 346 | FTRYPDVQTR | (SEQ ID NO: 2984) |
| 328 | FGASQDTLST | (SEQ ID NO: 2985) |
| 303 | KAAGDSHGGG | (SEQ ID NO: 2986) |
| 268 | FSNFLLDKFL | (SEQ ID NO: 2987) |
| 246 | WLQYFPNPVR | (SEQ ID NO: 2988) |
| 245 | PWLQYFPNPV | (SEQ ID NO: 2989) |
| 459 | RVMIFSVGKR | (SEQ ID NO: 2990) |
| 443 | ARFLDKDGLI | (SEQ ID NO: 2991) |
| 440 | FDPARFLDKD | (SEQ ID NO: 2992) |
| 438 | ENFDPARFLD | (SEQ ID NO: 2993) |
| 384 | FLYEAMRFSS | (SEQ ID NO: 2994) |
| 381 | VLAFLYEAMR | (SEQ ID NO: 2995) |
| 370 | PCMGDQPNLP | (SEQ ID NO: 2996) |
| 352 | VQTRVQAELD | (SEQ ID NO: 2997) |
| 334 | TLSTALQWLL | (SEQ ID NO: 2998) |
| 309 | HGGGARLDLE | (SEQ ID NO: 2999) |
| 295 | AFLLSAEKKA | (SEQ ID NO: 3000) |
| 262 | EQLNRNFSNF | (SEQ ID NO: 3001) |
| 252 | NPVRTVFREF | (SEQ ID NO: 3002) |
| 246 | WLQYFPNPVR | (SEQ ID NO: 3003) |
| 244 | MPWLQYFPNP | (SEQ ID NO: 3004) |
| 232 | GRTVGAGSLV | (SEQ ID NO: 3005) |

-continued

| | | |
|---|---|---|
| 226 | SHNEEFGRTV | (SEQ ID NO: 3006) |
| 188 | GAFLDPRPLT | (SEQ ID NO: 3007) |
| 169 | HVLSEARELV | (SEQ ID NO: 3008) |
| 134 | FGHYSEHWKV | (SEQ ID NO: 3009) |
| 122 | SFRVVSGGRS | (SEQ ID NO: 3010) |
| 89 | LGSCPIVVLN | (SEQ ID NO: 3011) |
| 76 | RLARRYGDVF | (SEQ ID NO: 3012) |
| 73 | SFARLARRYG | (SEQ ID NO: 3013) |
| 69 | AAHLSFARLA | (SEQ ID NO: 3014) |
| 68 | QAAHLSFARL | (SEQ ID NO: 3015) |
| 58 | PLIGNAAAVG | (SEQ ID NO: 3016) |
| 29 | VLATVHVGQR | (SEQ ID NO: 3017) |
| 22 | TLLLLLSVLA | (SEQ ID NO: 3018) |
| 15 | PLSIQQTTLL | (SEQ ID NO: 3019) |
| 8 | NDPWPLNPLS | (SEQ ID NO: 3020) |
| 527 | ELLDSAVQNL | (SEQ ID NO: 3021) |
| 518 | VNVTLRESME | (SEQ ID NO: 3022) |
| 512 | KPKSFKVNVT | (SEQ ID NO: 3023) |
| 507 | YGLTIKPKSF | (SEQ ID NO: 3024) |
| 495 | ANPNEPAKMN | (SEQ ID NO: 3025) |
| 488 | AHQCDFRANP | (SEQ ID NO: 3026) |
| 485 | SLLAHQCDFR | (SEQ ID NO: 3027) |
| 481 | FLFLSLLAHQ | (SEQ ID NO: 3028) |
| 476 | SKMQLFLFIS | (SEQ ID NO: 3029) |
| 467 | KRRCIGEELS | (SEQ ID NO: 3030) |
| 460 | VMIFSVGKRR | (SEQ ID NO: 3031) |
| 458 | SRVMIFSVGK | (SEQ ID NO: 3032) |
| 448 | KDGLINKDLT | (SEQ ID NO: 3033) |
| 446 | LDKDGLINKD | (SEQ ID NO: 3034) |
| 426 | SVNHDPLKWP | (SEQ ID NO: 3035) |
| 424 | QWSVNHDPLK | (SEQ ID NO: 3036) |
| 422 | VNQWSVNHDP | (SEQ ID NO: 3037) |
| 393 | SFVPVTIPHA | (SEQ ID NO: 3038) |
| 386 | YEAMRFSSFV | (SEQ ID NO: 3039) |
| 385 | LYEAMRFSSF | (SEQ ID NO: 3040) |
| 380 | YVLAFLYEAM | (SEQ ID NO: 3041) |
| 374 | DQPNLPYVLA | (SEQ ID NO: 3042) |
| 372 | MGDQPNLPYV | (SEQ ID NO: 3043) |
| 363 | VVGRDRLPCM | (SEQ ID NO: 3044) |
| 347 | TRYPDVQTRV | (SEQ ID NO: 3045) |
| 345 | LFTRYPDVQT | (SEQ ID NO: 3046) |
| 337 | TALQWLLLLF | (SEQ ID NO: 3047) |
| 329 | GASQDTLSTA | (SEQ ID NO: 3048) |
| 319 | NVPATLTDLF | (SEQ ID NO: 3049) |
| 295 | AFILSAEKKA | (SEQ ID NO: 3050) |
| 286 | GAAPRDMMDA | (SEQ ID NO: 3051) |
| 283 | LRPGAAPRDM | (SEQ ID NO: 3052) |
| 267 | NFSNFLLDKF | (SEQ ID NO: 3053) |
| 262 | EQLNRNFSNF | (SEQ ID NO: 3054) |
| 248 | QYFPNPVRTV | (SEQ ID NO: 3055) |
| 247 | LQYFPNPVRT | (SEQ ID NO: 3056) |
| 201 | VANVMSAVCF | (SEQ ID NO: 3057) |
| 199 | VAVANVMSAV | (SEQ ID NO: 3058) |
| 198 | VVAVANVMSA | (SEQ ID NO: 3059) |
| 195 | PLTVVAVANV | (SEQ ID NO: 3060) |
| 188 | GAFLDPRPLT | (SEQ ID NO: 3061) |
| 177 | LVALLVRGSA | (SEQ ID NO: 3062) |
| 165 | VLEGHVLSEA | (SEQ ID NO: 3063) |
| 156 | FTRQPRSRQV | (SEQ ID NO: 3064) |
| 146 | RAAHSMMRNF | (SEQ ID NO: 3065) |
| 143 | VQRRAAHSMM | (SEQ ID NO: 3066) |
| 124 | RVVSGGRSMA | (SEQ ID NO: 3067) |
| 94 | IVVLNGERAI | (SEQ ID NO: 3068) |
| 69 | AAHLSFARLA | (SEQ ID NO: 3069) |
| 66 | VGQAAHLSFA | (SEQ ID NO: 3070) |
| 55 | FAWPLIGNAA | (SEQ ID NO: 3071) |
| 22 | TLLLLLSVLA | (SEQ ID NO: 3072) |
| 20 | QTTLLLLLSV | (SEQ ID NO: 3073) |
| 509 | LTIKPKSFKV | (SEQ ID NO: 3074) |
| 484 | ISILAHQCDF | (SEQ ID NO: 3075) |
| 409 | VLGYHIPKDT | (SEQ ID NO: 3076) |
| 396 | PVTIPHATTA | (SEQ ID NO: 3077) |
| 394 | FVPVTIPHAT | (SEQ ID NO: 3078) |
| 343 | LLLFTRYPDV | (SEQ ID NO: 3079) |
| 316 | DLENVPATIT | (SEQ ID NO: 3080) |
| 315 | LDLENVPATI | (SEQ ID NO: 3081) |
| 311 | GGARLDLENV | (SEQ ID NO: 3082) |
| 296 | FLLSAEKKAA | (SEQ ID NO: 3083) |
| 279 | HCESLRPGAA | (SEQ ID NO: 3084) |
| 263 | QLNRNFSNFI | (SEQ ID NO: 3085) |
| 255 | RTVFREFE | (SEQ ID NO: 3086) |
| 254 | VRTVFREF | (SEQ ID NO: 3087) |
| 239 | SLVDVMPW | (SEQ ID NO: 3088) |
| 223 | ELLSHNEE | (SEQ ID NO: 3089) |
| 211 | GCRYSHDD | (SEQ ID NO: 3090) |
| 209 | CFGCRYSH | (SEQ ID NO: 3091) |
| 176 | ELVALLVR | (SEQ ID NO: 3092) |
| 171 | LSEARELV | (SEQ ID NO: 3093) |
| 157 | TRQPRSRQ | (SEQ ID NO: 3094) |
| 154 | NFFTRQPR | (SEQ ID NO: 3095) |
| 142 | KVQRRAAH | (SEQ ID NO: 3096) |
| 141 | WKVQRRAA | (SEQ ID NO: 3097) |
| 127 | SGGRSMAF | (SEQ ID NO: 3098) |
| 75 | ARLARRYG | (SEQ ID NO: 3099) |
| 72 | LSFARLAR | (SEQ ID NO: 3100) |
| 36 | GQRLLRQR | (SEQ ID NO: 3101) |
| 4 | SLSPNDPW | (SEQ ID NO: 3102) |
| 504 | NFSYGLTI | (SEQ ID NO: 3103) |
| 481 | FLFLSLLA | (SEQ ID NO: 3104) |
| 407 | TSVLGYHI | (SEQ ID NO: 3105) |
| 399 | IPHATTAN | (SEQ ID NO: 3106) |
| 395 | VPVTIPHA | (SEQ ID NO: 3107) |
| 381 | VLAFLYEA | (SEQ ID NO: 3108) |
| 366 | RDRLPCMG | (SEQ ID NO: 3109) |
| 349 | YPDVQTRV | (SEQ ID NO: 3110) |
| 342 | LLLLFTRY | (SEQ ID NO: 3111) |
| 341 | WLLLLFTR | (SEQ ID NO: 3112) |
| 339 | LQWLLLLF | (SEQ ID NO: 3113) |
| 317 | LENVPATI | (SEQ ID NO: 3114) |
| 314 | RLDLENVP | (SEQ ID NO: 3115) |
| 297 | ILSAEKKA | (SEQ ID NO: 3116) |
| 272 | ILDKFLRH | (SEQ ID NO: 3117) |
| 250 | FPNPVRTV | (SEQ ID NO: 3118) |
| 246 | WLQYFPNP | (SEQ ID NO: 3119) |
| 244 | MPWLQYFP | (SEQ ID NO: 3120) |
| 243 | VMPWLQYF | (SEQ ID NO: 3121) |
| 231 | FGRTVGAG | (SEQ ID NO: 3122) |
| 195 | PLTVVAVA | (SEQ ID NO: 3123) |
| 165 | VLEGHVLS | (SEQ ID NO: 3124) |
| 156 | FTRQPRSR | (SEQ ID NO: 3125) |
| 143 | VQRRAAHS | (SEQ ID NO: 3126) |
| 128 | GGRSMAFG | (SEQ ID NO: 3127) |
| 99 | GERAIHQA | (SEQ ID NO: 3128) |
| 92 | CPLVVLNG | (SEQ ID NO: 3129) |
| 87 | IRLGSCPI | (SEQ ID NO: 3130) |
| 232 | GRTVGAGSLV | (SEQ ID NO: 3131) |
| 200 | AVANVMSAVC | (SEQ ID NO: 3132) |
| 187 | DGAFLDPRPL | (SEQ ID NO: 3133) |
| 161 | RSRQVLEGHV | (SEQ ID NO: 3134) |
| 98 | NGERAIHQAL | (SEQ ID NO: 3135) |
| 83 | DVFQIRLGSC | (SEQ ID NO: 3136) |
| 69 | AAHLSFARLA | (SEQ ID NO: 3137) |
| 49 | SAPPGPFAWP | (SEQ ID NO: 3138) |
| 46 | QLRSAPPGPF | (SEQ ID NO: 3139) |
| 41 | RQRRRQLRSA | (SEQ ID NO: 3140) |
| 512 | KPKSFKVNVT | (SEQ ID NO: 3141) |
| 483 | FLSLLAHQCD | (SEQ ID NO: 3142) |
| 480 | LFLFLSLLAH | (SEQ ID NO: 3143) |
| 470 | CIGEELSKMQ | (SEQ ID NO: 3144) |
| 461 | MIFSVGKRRC | (SEQ ID NO: 3145) |
| 460 | VMIFSVGKRR | (SEQ ID NO: 3146) |
| 446 | LDKDGLINKD | (SEQ ID NO: 3147) |
| 404 | TANTSVLGYH | (SEQ ID NO: 3148) |
| 395 | VPVTIPHATT | (SEQ ID NO: 3149) |
| 377 | NLPYVLAFLY | (SEQ ID NO: 3150) |
| 358 | AELDQVVGRD | (SEQ ID NO: 3151) |
| 339 | LQWLLLLFTR | (SEQ ID NO: 3152) |
| 322 | ATITDIFGAS | (SEQ ID NO: 3153) |
| 321 | PATLTDLFGA | (SEQ ID NO: 3154) |
| 298 | LSAEKKAAGD | (SEQ ID NO: 3155) |
| 295 | AFILSAEKKA | (SEQ ID NO: 3156) |
| 243 | VMPWLQYFPN | (SEQ ID NO: 3157) |
| 223 | ELLSHNEEFG | (SEQ ID NO: 3158) |
| 204 | VMSAVCFGCR | (SEQ ID NO: 3159) |
| 181 | LVRGSADGAF | (SEQ ID NO: 3160) |
| 120 | FASFRVVSGG | (SEQ ID NO: 3161) |
| 116 | DRPAFASFRV | (SEQ ID NO: 3162) |
| 114 | FADRPAFASF | (SEQ ID NO: 3163) |

-continued

| | | |
|---|---|---|
| 95 | VVLNGERAIH | (SEQ ID NO: 3164) |
| 93 | PIVVLNGERA | (SEQ ID NO: 3165) |
| 66 | VGQAAHLSFA | (SEQ ID NO: 3166) |
| 65 | AVGQAAHLSF | (SEQ ID NO: 3167) |
| 64 | AAVGQAAHLS | (SEQ ID NO: 3168) |
| 62 | NAAAVGQAAH | (SEQ ID NO: 3169) |
| 421 | FVNQWSVNHD | (SEQ ID NO: 3170) |
| 419 | VVFVNQWSVN | (SEQ ID NO: 3171) |
| 414 | IPKDTVVFVN | (SEQ ID NO: 3172) |
| 409 | VLGYHIPKDT | (SEQ ID NO: 3173) |
| 405 | ANTSVLGYHI | (SEQ ID NO: 3174) |
| 389 | MRFSSFVPVT | (SEQ ID NO: 3175) |
| 386 | YEAMRFSSFV | (SEQ ID NO: 3176) |
| 380 | YVLAFLYEAM | (SEQ ID NO: 3177) |
| 374 | DQPNLPYVLA | (SEQ ID NO: 3178) |
| 364 | VGRDRLPCMG | (SEQ ID NO: 3179) |
| 361 | DQVVGRDRLP | (SEQ ID NO: 3180) |
| 358 | AELDQVVGRD | (SEQ ID NO: 3181) |
| 356 | VQAELDQVVG | (SEQ ID NO: 3182) |
| 344 | LLFTRYPDfiQ | (SEQ ID NO: 3183) |
| 342 | LLLLFTRYPD | (SEQ ID NO: 3184) |
| 327 | IFGASQDTLS | (SEQ ID NO: 3185) |
| 313 | ARLDLENVPA | (SEQ ID NO: 3186) |
| 304 | AAGDSHGGGA | (SEQ ID NO: 3187) |
| 300 | AEKKAAGDSH | (SEQ ID NO: 3188) |
| 294 | DAFILSAEKK | (SEQ ID NO: 3189) |
| 284 | RPGAAPRDMM | (SEQ ID NO: 3190) |
| 275 | KFLRHCESLR | (SEQ ID NO: 3191) |
| 267 | NFSNFILDKF | (SEQ ID NO: 3192) |
| 261 | FEQLNRNFSN | (SEQ ID NO: 3193) |
| 256 | TVFREFEQLN | (SEQ ID NO: 3194) |
| 237 | AGSLVDVMPW | (SEQ ID NO: 3195) |
| 229 | EEFGRTVGAG | (SEQ ID NO: 3196) |
| 208 | VCFGCRYSHD | (SEQ ID NO: 3197) |
| 207 | AVCFGCRYSH | (SEQ ID NO: 3198) |
| 202 | ANVMSAVCFG | (SEQ ID NO: 3199) |
| 200 | AVANVMSAVC | (SEQ ID NO: 3200) |
| 198 | VVAVANVMSA | (SEQ ID NO: 3201) |
| 197 | TVVAVANVMS | (SEQ ID NO: 3202) |
| 195 | PLTVVAVANV | (SEQ ID NO: 3203) |
| 193 | PRPLTVVAVA | (SEQ ID NO: 3204) |
| 183 | RGSADGAFLD | (SEQ ID NO: 3205) |
| 182 | VRGSADGAFL | (SEQ ID NO: 3206) |
| 179 | ALLVRGSADG | (SEQ ID NO: 3207) |
| 259 | REFEQLNRNF | (SEQ ID NO: 3208) |
| 245 | PWLQYFPNPV | (SEQ ID NO: 3209) |
| 225 | LSHNEEFGRT | (SEQ ID NO: 3210) |
| 222 | RELLSHNEEF | (SEQ ID NO: 3211) |
| 212 | CRYSHDDPEF | (SEQ ID NO: 3212) |
| 196 | LTVVAVANVM | (SEQ ID NO: 3213) |
| 169 | HVLSEARELV | (SEQ ID NO: 3214) |
| 142 | KVQRRAAHSM | (SEQ ID NO: 3215) |
| 116 | DRPAFASFRV | (SEQ ID NO: 3216) |
| 105 | QALVQQGSAF | (SEQ ID NO: 3217) |
| 104 | HQALVQQGSA | (SEQ ID NO: 3218) |
| 97 | LNGERAIHQA | (SEQ ID NO: 3219) |
| 85 | FQLRLGSCPI | (SEQ ID NO: 3220) |
| 54 | PFAWPLIGNA | (SEQ ID NO: 3221) |
| 24 | LLLLSVLATV | (SEQ ID NO: 3222) |
| 12 | PLNPLSIQQT | (SEQ ID NO: 3223) |
| 507 | YGLTIKPKSF | (SEQ ID NO: 3224) |
| 479 | QLFLFLSLLA | (SEQ ID NO: 3225) |
| 472 | GEELSKMQLF | (SEQ ID NO: 3226) |
| 431 | PLKWPNPENF | (SEQ ID NO: 3227) |
| 418 | TVVFVNQWSV | (SEQ ID NO: 3228) |
| 410 | LGYHIPKDTV | (SEQ ID NO: 3229) |
| 382 | LAFLYEAMRF | (SEQ ID NO: 3230) |
| 379 | PYVLAFLYEA | (SEQ ID NO: 3231) |
| 362 | QVVGRDRLPC | (SEQ ID NO: 3232) |
| 354 | TRVQAELDQV | (SEQ ID NO: 3233) |
| 325 | TDIFGASQDT | (SEQ ID NO: 3234) |
| 321 | PATITDIFGA | (SEQ ID NO: 3235) |
| 297 | ILSAEKKAAG | (SEQ ID NO: 3236) |
| 241 | VDVMPWLQYF | (SEQ ID NO: 3237) |
| 237 | AGSLVDVMPW | (SEQ ID NO: 3238) |
| 233 | RTVGAGSLVD | (SEQ ID NO: 3239) |
| 232 | GRTVGAGSLV | (SEQ ID NO: 3240) |
| 226 | SHNEEFGRTV | (SEQ ID NO: 3241) |
| 180 | LLVRGSADGA | (SEQ ID NO: 3242) |

-continued

| | | |
|---|---|---|
| 138 | SEHWKVQRRA | (SEQ ID NO: 3243) |
| 134 | FGHYSEHWKV | (SEQ ID NO: 3244) |
| 123 | FRVVSGGRSM | (SEQ ID NO: 3245) |
| 119 | AFASFRVVSG | (SEQ ID NO: 3246) |
| 71 | HLSFARLA | (SEQ ID NO: 3247) |
| 67 | GQAAHLSF | (SEQ ID NO: 3248) |
| 29 | VLATVHVG | (SEQ ID NO: 3249) |
| 26 | LLSVLATV | (SEQ ID NO: 3250) |
| 24 | LLLLSVLA | (SEQ ID NO: 3251) |
| 22 | TLLLLLSV | (SEQ ID NO: 3252) |
| 531 | SAVQNLQA | (SEQ ID NO: 3253) |
| 528 | LLDSAVQN | (SEQ ID NO: 3254) |
| 509 | LTIKPKSF | (SEQ ID NO: 3255) |
| 492 | DFRANPNE | (SEQ ID NO: 3256) |
| 485 | SILAHQCD | (SEQ ID NO: 3257) |
| 470 | CIGEELSK | (SEQ ID NO: 3258) |
| 467 | KRRCIGEE | (SEQ ID NO: 3259) |
| 456 | LTSRVMIF | (SEQ ID NO: 3260) |
| 441 | DPARFLDK | (SEQ ID NO: 3261) |
| 436 | NPENFDPA | (SEQ ID NO: 3262) |
| 434 | WPNPENFD | (SEQ ID NO: 3263) |
| 433 | KWPNPENF | (SEQ ID NO: 3264) |
| 430 | DPLKWPNP | (SEQ ID NO: 3265) |
| 388 | AMRFSSFV | (SEQ ID NO: 3266) |
| 369 | LPCMGDQP | (SEQ ID NO: 3267) |
| 368 | RLPCMGDQ | (SEQ ID NO: 3268) |
| 343 | LLLFTRYP | (SEQ ID NO: 3269) |
| 334 | TLSTALQW | (SEQ ID NO: 3270) |
| 316 | DLENVPAT | (SEQ ID NO: 3271) |
| 290 | RDMMDAFI | (SEQ ID NO: 3272) |
| 289 | PRDMMDAF | (SEQ ID NO: 3273) |
| 284 | RPGAAPRD | (SEQ ID NO: 3274) |
| 265 | NRNFSNFI | (SEQ ID NO: 3275) |
| 263 | QLNRNFSN | (SEQ ID NO: 3276) |
| 253 | PVRTVFRE | (SEQ ID NO: 3277) |
| 252 | NPVRTVFR | (SEQ ID NO: 3278) |
| 214 | YSHDDPEF | (SEQ ID NO: 3279) |
| 206 | SAVCFGCR | (SEQ ID NO: 3280) |
| 203 | NVMSAVCF | (SEQ ID NO: 3281) |
| 201 | VANVMSAV | (SEQ ID NO: 3282) |
| 194 | RPLTVVAV | (SEQ ID NO: 3283) |
| 188 | GAFLDPRP | (SEQ ID NO: 3284) |
| 185 | SADGAFLD | (SEQ ID NO: 3285) |
| 56 | AWPLIGNAAA | (SEQ ID NO: 3286) |
| 510 | TIKPKSFKVN | (SEQ ID NO: 3287) |
| 455 | DLTSRVMIFS | (SEQ ID NO: 3288) |
| 412 | YHIPKDTVVF | (SEQ ID NO: 3289) |
| 379 | PYVLAFLYEA | (SEQ ID NO: 3290) |
| 349 | YPDVQTRVQA | (SEQ ID NO: 3291) |
| 283 | LRPGAAPRDM | (SEQ ID NO: 3292) |
| 278 | RHCESLRPGA | (SEQ ID NO: 3293) |
| 247 | LQYFPNPVRT | (SEQ ID NO: 3294) |
| 207 | AVCFGCRYSH | (SEQ ID NO: 3295) |
| 201 | VANVMSAVCF | (SEQ ID NO: 3296) |
| 191 | LDPRPLTVVA | (SEQ ID NO: 3297) |
| 178 | VALLVRGSAD | (SEQ ID NO: 3298) |
| 175 | RELVALLVRG | (SEQ ID NO: 3299) |
| 151 | MMRNFFTRQP | (SEQ ID NO: 3300) |
| 125 | VVSGGRSMAF | (SEQ ID NO: 3301) |
| 124 | RVVSGGRSMA | (SEQ ID NO: 3302) |
| 104 | HQALVQQGSA | (SEQ ID NO: 3303) |
| 91 | SCPIVVLNGE | (SEQ ID NO: 3304) |
| 90 | GSCPIVVLNG | (SEQ ID NO: 3305) |
| 89 | LGSCPIVVLN | (SEQ ID NO: 3306) |
| 77 | LARRYGDVFQ | (SEQ ID NO: 3307) |
| 61 | GNAAAVGQAA | (SEQ ID NO: 3308) |
| 51 | PPGPFAWPLI | (SEQ ID NO: 3309) |
| 34 | HVGQRLLRQR | (SEQ ID NO: 3310) |
| 33 | VHVGQRLLRQ | (SEQ ID NO: 3311) |
| 13 | LNPLSIQQTT | (SEQ ID NO: 3312) |
| 529 | LDSAVQNLQA | (SEQ ID NO: 3313) |
| 516 | FKVNVTLRES | (SEQ ID NO: 3314) |
| 505 | FSYGLTIKPK | (SEQ ID NO: 3315) |
| 487 | LAHQCDFRAN | (SEQ ID NO: 3316) |
| 476 | SKMQLFLFIS | (SEQ ID NO: 3317) |
| 464 | SVGKRRCIGE | (SEQ ID NO: 3318) |
| 454 | KDLTSRVMIF | (SEQ ID NO: 3319) |
| 440 | FDPARFLDKD | (SEQ ID NO: 3320) |
| 437 | PENFDPARFL | (SEQ ID NO: 3321) |

-continued

| | | |
|---|---|---|
| 434 | WPNPENFDPA | (SEQ ID NO: 3322) |
| 402 | ATTANTSVLG | (SEQ ID NO: 3323) |
| 382 | LAFLYEAMRF | (SEQ ID NO: 3324) |
| 375 | QPNLPYVLAF | (SEQ ID NO: 3325) |
| 362 | QVVGRDRLPC | (SEQ ID NO: 3326) |
| 359 | ELDQVVGRDR | (SEQ ID NO: 3327) |
| 356 | VQAELDQVVG | (SEQ ID NO: 3328) |
| 345 | LFTRYPDVQT | (SEQ ID NO: 3329) |
| 178 | VALLVRGSAD | (SEQ ID NO: 3330) |
| 176 | ELVALLVRGS | (SEQ ID NO: 3331) |
| 163 | RQVLEGHVLS | (SEQ ID NO: 3332) |
| 158 | RQPRSRQVLE | (SEQ ID NO: 3333) |
| 155 | FFTRQPRSRQ | (SEQ ID NO: 3334) |
| 148 | AHSMMRNFFT | (SEQ ID NO: 3335) |
| 147 | AAHSMMRNFF | (SEQ ID NO: 3336) |
| 143 | VQRRAAHSMM | (SEQ ID NO: 3337) |
| 138 | SEHWKVQRRA | (SEQ ID NO: 3338) |
| 131 | SMAFGHYSEH | (SEQ ID NO: 3339) |
| 127 | SGGRSMAFGH | (SEQ ID NO: 3340) |
| 125 | VVSGGRSMAF | (SEQ ID NO: 3341) |
| 124 | RVVSGGRSMA | (SEQ ID NO: 3342) |
| 123 | FRVVSGGRSM | (SEQ ID NO: 3343) |
| 120 | FASFRVVSGG | (SEQ ID NO: 3344) |
| 119 | AFASFRVVSG | (SEQ ID NO: 3345) |
| 118 | PAFASFRVVS | (SEQ ID NO: 3346) |
| 112 | SAFADRPAFA | (SEQ ID NO: 3347) |
| 106 | ALVQQGSAFA | (SEQ ID NO: 3348) |
| 102 | AIHQALVQQG | (SEQ ID NO: 3349) |
| 99 | GERAIHQALV | (SEQ ID NO: 3350) |
| 95 | VVLNGERAIH | (SEQ ID NO: 3351) |
| 91 | SCPIVVLNGE | (SEQ ID NO: 3352) |
| 88 | RLGSCPIVVL | (SEQ ID NO: 3353) |
| 84 | VFQIRLGSCP | (SEQ ID NO: 3354) |
| 78 | ARRYGDVFQI | (SEQ ID NO: 3355) |
| 74 | FARLARRYGD | (SEQ ID NO: 3356) |
| 56 | AWPLIGNAAA | (SEQ ID NO: 3357) |
| 50 | APPGPFAWPL | (SEQ ID NO: 3358) |
| 38 | RLLRQRRRQL | (SEQ ID NO: 3359) |
| 35 | VGQRLLRQRR | (SEQ ID NO: 3360) |
| 28 | SVLATVHVGQ | (SEQ ID NO: 3361) |
| 25 | LLLSVLATVH | (SEQ ID NO: 3362) |
| 533 | VQNLQAKETC | (SEQ ID NO: 3363) |
| 532 | AVQNLQAKET | (SEQ ID NO: 3364) |
| 517 | KVNVTLRESM | (SEQ ID NO: 3365) |
| 516 | FKVNVTLRES | (SEQ ID NO: 3366) |
| 513 | PKSFKVNVTL | (SEQ ID NO: 3367) |
| 508 | GLTIKPKSFK | (SEQ ID NO: 3368) |
| 493 | FRANPNEPAK | (SEQ ID NO: 3369) |
| 492 | DFRANPNEPA | (SEQ ID NO: 3370) |
| 486 | ILAHQCDFEA | (SEQ ID NO: 3371) |
| 483 | FISILAHQCD | (SEQ ID NO: 3372) |
| 470 | CIGEELSKMQ | (SEQ ID NO: 3373) |
| 115 | ADRPAFASFR | (SEQ ID NO: 3374) |
| 93 | PIVVLNGERA | (SEQ ID NO: 3375) |
| 70 | AHLSFARLAR | (SEQ ID NO: 3376) |
| 13 | LNPLSIQQTT | (SEQ ID NO: 3377) |
| 439 | NFDPARFLDK | (SEQ ID NO: 3378) |
| 402 | ATTANTSVLG | (SEQ ID NO: 3379) |
| 229 | EEFGRTVGAG | (SEQ ID NO: 3380) |
| 200 | AVANVMSAVC | (SEQ ID NO: 3381) |
| 186 | ADGAFLDPRP | (SEQ ID NO: 3382) |
| 174 | ARELVALLVR | (SEQ ID NO: 3383) |
| 126 | VSGGRSMAFG | (SEQ ID NO: 3384) |
| 118 | PAFASFRVVS | (SEQ ID NO: 3385) |
| 100 | ERAIHQALVQ | (SEQ ID NO: 3386) |
| 89 | LGSCPLVVLN | (SEQ ID NO: 3387) |
| 77 | LARRYGDVFQ | (SEQ ID NO: 3388) |
| 43 | RRRQLRSAPP | (SEQ ID NO: 3389) |
| 521 | TLRESMELLD | (SEQ ID NO: 3390) |
| 514 | KSFKVNVTLR | (SEQ ID NO: 3391) |
| 488 | AHQCDFRANP | (SEQ ID NO: 3392) |
| 457 | TSRVMIFSVG | (SEQ ID NO: 3393) |
| 415 | PKDTVVFVNQ | (SEQ ID NO: 3394) |
| 403 | TTANTSVLGY | (SEQ ID NO: 3395) |
| 397 | VTIPHATTAN | (SEQ ID NO: 3396) |
| 391 | FSSFVPVTIP | (SEQ ID NO: 3397) |
| 371 | CMGDQPNLPY | (SEQ ID NO: 3398) |
| 356 | VQAELDQVVG | (SEQ ID NO: 3399) |
| 353 | QTRVQAELDQ | (SEQ ID NO: 3400) |

-continued

| | | |
|---|---|---|
| 327 | IFGASQDTLS | (SEQ ID NO: 3401) |
| 322 | ATLTDLFGAS | (SEQ ID NO: 3402) |
| 310 | GGGARLDLEN | (SEQ ID NO: 3403) |
| 305 | AGDSHGGGAR | (SEQ ID NO: 3404) |
| 303 | KAAGDSHGGG | (SEQ ID NO: 3405) |
| 282 | SLRPGAAPRD | (SEQ ID NO: 3406) |
| 280 | CESLRPGAAP | (SEQ ID NO: 3407) |
| 276 | FLRHCESLRP | (SEQ ID NO: 3408) |
| 272 | ILDKFLRHCE | (SEQ ID NO: 3409) |
| 257 | VFREFEQLNR | (SEQ ID NO: 3410) |
| 253 | PVRTVFREFE | (SEQ ID NO: 3411) |
| 213 | RYSHDDPEFR | (SEQ ID NO: 3412) |
| 204 | VMSAVCFGCR | (SEQ ID NO: 3413) |
| 202 | ANVMSAVCFG | (SEQ ID NO: 3414) |
| 185 | SADGAFLDPR | (SEQ ID NO: 3415) |
| 184 | GSADGAFLDP | (SEQ ID NO: 3416) |
| 183 | RGSADGAFLD | (SEQ ID NO: 3417) |
| 136 | HYSEHWKVQR | (SEQ ID NO: 3418) |
| 183 | RGSADGAF | (SEQ ID NO: 3419) |
| 181 | LVRGSADG | (SEQ ID NO: 3420) |
| 180 | LLVRGSAD | (SEQ ID NO: 3421) |
| 178 | VALLVRGS | (SEQ ID NO: 3422) |
| 161 | RSRQVLEG | (SEQ ID NO: 3423) |
| 151 | MMRNFFTR | (SEQ ID NO: 3424) |
| 148 | AHSMMRNF | (SEQ ID NO: 3425) |
| 144 | QRRAAHSM | (SEQ ID NO: 3426) |
| 117 | RPAFASFR | (SEQ ID NO: 3427) |
| 116 | DRPAFASF | (SEQ ID NO: 3428) |
| 115 | ADRPAFAS | (SEQ ID NO: 3429) |
| 112 | SAFADRPA | (SEQ ID NO: 3430) |
| 107 | LVQQGSAF | (SEQ ID NO: 3431) |
| 106 | ALVQQGSA | (SEQ ID NO: 3432) |
| 88 | RLGSCPIV | (SEQ ID NO: 3433) |
| 80 | RYGDVFQI | (SEQ ID NO: 3434) |
| 58 | PLIGNAAA | (SEQ ID NO: 3435) |
| 57 | WPLIGNAA | (SEQ ID NO: 3436) |
| 51 | PPGPFAWP | (SEQ ID NO: 3437) |
| 50 | APPGPFAW | (SEQ ID NO: 3438) |
| 49 | SAPPGPFA | (SEQ ID NO: 3439) |
| 48 | RSAPPGPF | (SEQ ID NO: 3440) |
| 43 | RRRQLRSA | (SEQ ID NO: 3441) |
| 42 | QRRRQLRS | (SEQ ID NO: 3442) |
| 38 | RLLRQRRR | (SEQ ID NO: 3443) |
| 25 | LLLSVLAT | (SEQ ID NO: 3444) |
| 15 | PLSLQQTT | (SEQ ID NO: 3445) |
| 14 | NPLSLQQT | (SEQ ID NO: 3446) |
| 12 | PLNPLSIQ | (SEQ ID NO: 3447) |
| 483 | FLSLLAHQ | (SEQ ID NO: 3448) |
| 401 | HATTANTS | (SEQ ID NO: 3449) |
| 382 | LAFLYEAM | (SEQ ID NO: 3450) |
| 357 | QAELDQVV | (SEQ ID NO: 3451) |
| 329 | GASQDTLS | (SEQ ID NO: 3452) |
| 296 | FILSAEKK | (SEQ ID NO: 3453) |
| 236 | GAGSLVDV | (SEQ ID NO: 3454) |
| 199 | VAVANVMS | (SEQ ID NO: 3455) |
| 114 | FADRPAFA | (SEQ ID NO: 3456) |
| 105 | QALVQQGS | (SEQ ID NO: 3457) |
| 93 | PIVVLNGE | (SEQ ID NO: 3458) |
| 69 | AAHLSFAR | (SEQ ID NO: 3459) |
| 63 | AAAVGQAA | (SEQ ID NO: 3460) |
| 55 | FAWPLIGN | (SEQ ID NO: 3461) |
| 30 | LATVHVGQ | (SEQ ID NO: 3462) |
| 289 | PRDMMDAFIL | (SEQ ID NO: 3463) |
| 287 | AAPRDMMDAF | (SEQ ID NO: 3464) |
| 242 | DVMPWLQYFP | (SEQ ID NO: 3465) |
| 240 | LVDVMPWLQY | (SEQ ID NO: 3466) |
| 236 | GAGSLVDVMP | (SEQ ID NO: 3467) |
| 233 | RTVGAGSLVD | (SEQ ID NO: 3468) |
| 193 | PRPLTVVAVA | (SEQ ID NO: 3469) |
| 159 | QPRSRQVLEG | (SEQ ID NO: 3470) |
| 147 | AAHSMMRNFF | (SEQ ID NO: 3471) |
| 132 | MAFGHYSEHW | (SEQ ID NO: 3472) |
| 123 | FRVVSGGRSM | (SEQ ID NO: 3473) |
| 107 | LVQQGSAFAD | (SEQ ID NO: 3474) |
| 105 | QALVQQGSAF | (SEQ ID NO: 3475) |
| 74 | FARLARRYGD | (SEQ ID NO: 3476) |
| 54 | PFAWPLIGNA | (SEQ ID NO: 3477) |
| 53 | GPFAWPLIGN | (SEQ ID NO: 3478) |
| 47 | LRSAPPGPFA | (SEQ ID NO: 3479) |

| | | |
|---|---|---|
| 27 | LSVLATVHVG | (SEQ ID NO: 3480) |
| 530 | DSAVQNLAK | (SEQ ID NO: 3481) |
| 522 | LRESMELLDS | (SEQ ID NO: 3482) |
| 514 | KSFKVNVTLR | (SEQ ID NO: 3483) |
| 465 | VGKRRCIGEE | (SEQ ID NO: 3484) |
| 452 | INKDLTSRVM | (SEQ ID NO: 3485) |
| 432 | LKWPNPENFD | (SEQ ID NO: 3486) |
| 431 | PLKWPNPENF | (SEQ ID NO: 3487) |
| 419 | VVFVNQWSVN | (SEQ ID NO: 3488) |
| 414 | IPKDTVVFVN | (SEQ ID NO: 3489) |
| 396 | PVTIPHATTA | (SEQ ID NO: 3490) |
| 324 | ITDIFGASQD | (SEQ ID NO: 3491) |
| 312 | GARLDLENVP | (SEQ ID NO: 3492) |
| 309 | HGGGARLDLE | (SEQ ID NO: 3493) |
| 294 | DAFILSAEKK | (SEQ ID NO: 3494) |
| 277 | LRHCESLRPG | (SEQ ID NO: 3495) |
| 267 | NFSNFILDKF | (SEQ ID NO: 3496) |
| 266 | RNFSNFILDK | (SEQ ID NO: 3497) |
| 250 | FPNPVRTVFR | (SEQ ID NO: 3498) |
| 237 | AGSLVDVMPW | (SEQ ID NO: 3499) |
| 225 | LSHNEEFGRT | (SEQ ID NO: 3500) |
| 206 | SAVCFGCRYS | (SEQ ID NO: 3501) |
| 203 | NVMSAVCFGC | (SEQ ID NO: 3502) |
| 202 | ANVMSAVCFG | (SEQ ID NO: 3503) |
| 197 | TVVAVANVMS | (SEQ ID NO: 3504) |
| 174 | ARELVALLVR | (SEQ ID NO: 3505) |
| 148 | AMSMMRNFFT | (SEQ ID NO: 3506) |
| 465 | VGKRRCIGEE | (SEQ ID NO: 3507) |
| 462 | IFSVGKRRCI | (SEQ ID NO: 3508) |
| 454 | KDLTSRVMIF | (SEQ ID NO: 3509) |
| 452 | INKDLTSRVM | (SEQ ID NO: 3510) |
| 450 | GLINKDLTSR | (SEQ ID NO: 3511) |
| 433 | KWPNPENFDP | (SEQ ID NO: 3512) |
| 431 | PLKWPNPENF | (SEQ ID NO: 3513) |
| 430 | DPLKWPNPEN | (SEQ ID NO: 3514) |
| 427 | VNHDPLKWPN | (SEQ ID NO: 3515) |
| 420 | VFVNQWSVNH | (SEQ ID NO: 3516) |
| 416 | KDTVVFVNQW | (SEQ ID NO: 3517) |
| 413 | HIPKDTVVFV | (SEQ ID NO: 3518) |
| 411 | GYHIPKDTVV | (SEQ ID NO: 3519) |
| 401 | HATTANTSIL | (SEQ ID NO: 3520) |
| 400 | PHATTANTSV | (SEQ ID NO: 3521) |
| 395 | VPVTIPHATT | (SEQ ID NO: 3522) |
| 394 | FVPVTIPHAT | (SEQ ID NO: 3523) |
| 387 | EAMRFSSFVP | (SEQ ID NO: 3524) |
| 383 | AFLYEAMRFS | (SEQ ID NO: 3525) |
| 368 | RLPCMGDQPN | (SEQ ID NO: 3526) |
| 363 | VVGRDRLPCM | (SEQ ID NO: 3527) |
| 360 | LDQVVGRDRL | (SEQ ID NO: 3528) |
| 355 | RVQAELDQVV | (SEQ ID NO: 3529) |
| 350 | PDVQTRVQAE | (SEQ ID NO: 3530) |
| 348 | RYPDVQTRVQ | (SEQ ID NO: 3531) |
| 343 | LLLFTRYPDV | (SEQ ID NO: 3532) |
| 341 | WLLLLFTRYP | (SEQ ID NO: 3533) |
| 326 | DIFGASQDTL | (SEQ ID NO: 3534) |
| 312 | GARLDLENVP | (SEQ ID NO: 3535) |
| 306 | GDSHGGGARL | (SEQ ID NO: 3536) |
| 303 | KAAGDSHGGG | (SEQ ID NO: 3537) |
| 297 | ILSAEKKAAG | (SEQ ID NO: 3538) |
| 296 | FILSAEKKAA | (SEQ ID NO: 3539) |
| 288 | APRDMMDAFI | (SEQ ID NO: 3540) |
| 287 | AAPRDMMDAF | (SEQ ID NO: 3541) |
| 285 | PGAAPRDMMD | (SEQ ID NO: 3542) |
| 283 | LRPGAAPRDM | (SEQ ID NO: 3543) |
| 280 | CESLRPGAAP | (SEQ ID NO: 3544) |
| 278 | RHCESLRPGA | (SEQ ID NO: 3545) |
| 271 | FILDKFLRHC | (SEQ ID NO: 3546) |
| 264 | LNRNFSNFIL | (SEQ ID NO: 3547) |
| 263 | QLNRNFSNFI | (SEQ ID NO: 3548) |
| 259 | REFEQLNRNF | (SEQ ID NO: 3549) |
| 113 | AFADRPAFAS | (SEQ ID NO: 3550) |
| 108 | VQQGSAFADR | (SEQ ID NO: 3551) |
| 90 | GSCPIVVLNG | (SEQ ID NO: 3552) |
| 79 | RRYGDVFQIR | (SEQ ID NO: 3553) |
| 64 | AAVGQAAHLS | (SEQ ID NO: 3554) |
| 62 | NAAAVGQAAH | (SEQ ID NO: 3555) |
| 58 | PLIGNAAAVG | (SEQ ID NO: 3556) |
| 48 | RSAPPGPFAW | (SEQ ID NO: 3557) |
| 42 | QRRRQLRSAP | (SEQ ID NO: 3558) |
| 33 | VHVGQRLLRQ | (SEQ ID NO: 3559) |
| 515 | SFKVNVTLRE | (SEQ ID NO: 3560) |
| 510 | TIKPKSFKVN | (SEQ ID NO: 3561) |
| 505 | FSYGLTIKPK | (SEQ ID NO: 3562) |
| 504 | NFSYGLTIKP | (SEQ ID NO: 3563) |
| 493 | FRANPNEPAK | (SEQ ID NO: 3564) |
| 480 | LFLFLSLLAH | (SEQ ID NO: 3565) |
| 468 | RRCIGEELSK | (SEQ ID NO: 3566) |
| 467 | KRRCIGEELS | (SEQ ID NO: 3567) |
| 463 | FSVGKRRCIG | (SEQ ID NO: 3568) |
| 459 | RVMIFSVGKR | (SEQ ID NO: 3569) |
| 444 | RFLDKDGLIN | (SEQ ID NO: 3570) |
| 428 | NHDPLKWPNP | (SEQ ID NO: 3571) |
| 424 | QWSVNHDPLK | (SEQ ID NO: 3572) |
| 408 | SVLGYHIPKD | (SEQ ID NO: 3573) |
| 387 | EAMRFSSFVP | (SEQ ID NO: 3574) |
| 383 | AFLYEAMRFS | (SEQ ID NO: 3575) |
| 370 | PCMGDQPNLP | (SEQ ID NO: 3576) |
| 366 | RDRLPCMGDQ | (SEQ ID NO: 3577) |
| 358 | AELDQVVGRD | (SEQ ID NO: 3578) |
| 357 | QAELDQVVGR | (SEQ ID NO: 3579) |
| 348 | RYPDVQTRVQ | (SEQ ID NO: 3580) |
| 346 | FTRYPDVQTR | (SEQ ID NO: 3581) |
| 331 | SQDTLSTALQ | (SEQ ID NO: 3582) |
| 312 | GARLDLENVP | (SEQ ID NO: 3583) |
| 309 | HGGGARLDLE | (SEQ ID NO: 3584) |
| 302 | KKAAGDSHGG | (SEQ ID NO: 3585) |
| 300 | AEKKAAGDSH | (SEQ ID NO: 3586) |
| 292 | MMDAFILSAE | (SEQ ID NO: 3587) |
| 290 | RDMMDAFILS | (SEQ ID NO: 3588) |
| 281 | ESLRPGAAPR | (SEQ ID NO: 3589) |
| 270 | NFILDKFLRH | (SEQ ID NO: 3590) |
| 266 | RNFSNFILDK | (SEQ ID NO: 3591) |
| 260 | EFEQLNRNFS | (SEQ ID NO: 3592) |
| 242 | DVMPWLQYFP | (SEQ ID NO: 3593) |
| 524 | ESMELLDS | (SEQ ID NO: 3594) |
| 494 | RANPNEPA | (SEQ ID NO: 3595) |
| 487 | LAHQCDFR | (SEQ ID NO: 3596) |
| 461 | MIFSVGKR | (SEQ ID NO: 3597) |
| 404 | TANTSVLG | (SEQ ID NO: 3598) |
| 398 | TIPHATTA | (SEQ ID NO: 3599) |
| 326 | DIFGASQD | (SEQ ID NO: 3600) |
| 323 | TITDIFGA | (SEQ ID NO: 3601) |
| 304 | AAGDSHGG | (SEQ ID NO: 3602) |
| 303 | KAAGDSHG | (SEQ ID NO: 3603) |
| 294 | DAFILSAE | (SEQ ID NO: 3604) |
| 287 | AAPRDMMD | (SEQ ID NO: 3605) |
| 226 | SHNEEFGR | (SEQ ID NO: 3606) |
| 147 | AAHSMMRN | (SEQ ID NO: 3607) |
| 146 | RAAHSMMR | (SEQ ID NO: 3608) |
| 132 | MAFGHYSE | (SEQ ID NO: 3609) |
| 118 | PAFASFRV | (SEQ ID NO: 3610) |
| 102 | AIHQALVQ | (SEQ ID NO: 3611) |
| 101 | RAIHQALV | (SEQ ID NO: 3612) |
| 68 | QAAHLSFA | (SEQ ID NO: 3613) |
| 64 | AAVGQAAH | (SEQ ID NO: 3614) |
| 62 | NAAAVGQA | (SEQ ID NO: 3615) |
| 59 | LIGNAAAV | (SEQ ID NO: 3616) |
| 525 | SMELLDSA | (SEQ ID NO: 3617) |
| 506 | SYGLTIKP | (SEQ ID NO: 3618) |
| 471 | IGEELSKM | (SEQ ID NO: 3619) |
| 356 | VQAELDQV | (SEQ ID NO: 3620) |
| 227 | HNEEFGRT | (SEQ ID NO: 3621) |
| 167 | EGHVLSEA | (SEQ ID NO: 3622) |
| 162 | SRQVLEGH | (SEQ ID NO: 3623) |
| 136 | HYSEHWKV | (SEQ ID NO: 3624) |
| 533 | VQNLAKE | (SEQ ID NO: 3625) |
| 484 | ISILAHQC | (SEQ ID NO: 3626) |
| 472 | GEELSKMQ | (SEQ ID NO: 3627) |
| 462 | IFSVGKRR | (SEQ ID NO: 3628) |
| 458 | SRVMIFSV | (SEQ ID NO: 3629) |
| 435 | PNPENFDP | (SEQ ID NO: 3630) |
| 426 | SVNHDPLK | (SEQ ID NO: 3631) |
| 419 | VVFVNQWS | (SEQ ID NO: 3632) |
| 408 | SVLGYHIP | (SEQ ID NO: 3633) |
| 394 | FVPVTIPH | (SEQ ID NO: 3634) |
| 393 | SFVPVTLP | (SEQ ID NO: 3635) |
| 331 | SQDTLSTA | (SEQ ID NO: 3636) |
| 146 | RAAHSMMRNF | (SEQ ID NO: 3637) |

| | | |
|---|---|---|
| 138 | SEHWKVQRRA | (SEQ ID NO: 3638) |
| 113 | AFADRPAFAS | (SEQ ID NO: 3639) |
| 81 | YGDVFQIRLG | (SEQ ID NO: 3640) |
| 70 | AHLSFARLAR | (SEQ ID NO: 3641) |
| 507 | YGLTIKPKSF | (SEQ ID NO: 3642) |
| 506 | SYGLTIKPKS | (SEQ ID NO: 3643) |
| 503 | MNFSYGLTIK | (SEQ ID NO: 3644) |
| 493 | FRANPNEPAK | (SEQ ID NO: 3645) |
| 482 | LFLSLLAHQC | (SEQ ID NO: 3646) |
| 458 | SRVMIFSVGK | (SEQ ID NO: 3647) |
| 448 | KDGLINKDLT | (SEQ ID NO: 3648) |
| 416 | KDTVVFVNQW | (SEQ ID NO: 3649) |
| 406 | NTSVLGYHIP | (SEQ ID NO: 3650) |
| 399 | IPHATTANTS | (SEQ ID NO: 3651) |
| 374 | DQPNLPYVLA | (SEQ ID NO: 3652) |
| 353 | QTRVQAELDQ | (SEQ ID NO: 3653) |
| 325 | TDIFGASQDT | (SEQ ID NO: 3654) |
| 299 | SAEKKAAGDS | (SEQ ID NO: 3655) |
| 293 | MDAFILSAEK | (SEQ ID NO: 3656) |
| 256 | TVFREFEQLN | (SEQ ID NO: 3657) |
| 241 | VDVMPWLQYF | (SEQ ID NO: 3658) |
| 229 | EEFGRTVGAG | (SEQ ID NO: 3659) |
| 228 | NEEFGRTVGA | (SEQ ID NO: 3660) |
| 194 | RPLTVVAVAN | (SEQ ID NO: 3661) |
| 184 | GSADGAFLDP | (SEQ ID NO: 3662) |
| 143 | VQRRAAHSMM | (SEQ ID NO: 3663) |
| 137 | YSEHWKVQRR | (SEQ ID NO: 3664) |
| 126 | VSGGRSMAFG | (SEQ ID NO: 3665) |
| 108 | VQQGSAFADR | (SEQ ID NO: 3666) |
| 48 | RSAPPGPFAW | (SEQ ID NO: 3667) |
| 32 | TVHVGQRLLR | (SEQ ID NO: 3668) |
| 2 | GTSLSPNDPW | (SEQ ID NO: 3669) |
| 533 | VQNLQAKETC | (SEQ ID NO: 3670) |
| 526 | MELLDSAVQN | (SEQ ID NO: 3671) |
| 254 | VRTVFREFEQ | (SEQ ID NO: 3672) |
| 253 | PVRTVFREFE | (SEQ ID NO: 3673) |
| 251 | PNPVRTVFRE | (SEQ ID NO: 3674) |
| 243 | VMPWLQYFPN | (SEQ ID NO: 3675) |
| 241 | VDVMPWLQYF | (SEQ ID NO: 3676) |
| 236 | GAGSLVDVMP | (SEQ ID NO: 3677) |
| 231 | FGRTVGAGSL | (SEQ ID NO: 3678) |
| 230 | EFGRTVGAGS | (SEQ ID NO: 3679) |
| 224 | LLSHNEEFGR | (SEQ ID NO: 3680) |
| 223 | ELLSHNEEFG | (SEQ ID NO: 3681) |
| 222 | RELLSHNEEF | (SEQ ID NO: 3682) |
| 210 | FGCRYSHDDP | (SEQ ID NO: 3683) |
| 201 | VANVMSAVCF | (SEQ ID NO: 3684) |
| 199 | VAVANVMSAV | (SEQ ID NO: 3685) |
| 191 | LDPRPLTVVA | (SEQ ID NO: 3686) |
| 186 | ADGAFLDPRP | (SEQ ID NO: 3687) |
| 181 | LVRGSADGAF | (SEQ ID NO: 3688) |
| 180 | LLVRGSADGA | (SEQ ID NO: 3689) |
| 177 | LVALLVRGSA | (SEQ ID NO: 3690) |
| 152 | MRNFFTRQPR | (SEQ ID NO: 3691) |
| 144 | QRRAAHSMMR | (SEQ ID NO: 3692) |
| 140 | HWKVQRRAAH | (SEQ ID NO: 3693) |
| 139 | EHWKVQRRAA | (SEQ ID NO: 3694) |
| 135 | GHYSEHWKVQ | (SEQ ID NO: 3695) |
| 133 | AFGHYSEHWK | (SEQ ID NO: 3696) |
| 132 | MAFGHYSEHW | (SEQ ID NO: 3697) |
| 129 | GRSMAFGHYS | (SEQ ID NO: 3698) |
| 113 | AFADRPAFAS | (SEQ ID NO: 3699) |
| 105 | QALVQQGSAF | (SEQ ID NO: 3700) |
| 93 | PIVVLNGERA | (SEQ ID NO: 3701) |
| 92 | CPIVVLNGER | (SEQ ID NO: 3702) |
| 85 | FQLRLGSCPI | (SEQ ID NO: 3703) |
| 75 | ARLARRYGDV | (SEQ ID NO: 3704) |
| 71 | HLSFARLARR | (SEQ ID NO: 3705) |
| 66 | VGQAAHLSFA | (SEQ ID NO: 3706) |
| 63 | AAAVGQAAHL | (SEQ ID NO: 3707) |
| 61 | GNAAAVGQAA | (SEQ ID NO: 3708) |
| 60 | IGNAAAVGQA | (SEQ ID NO: 3709) |
| 240 | LVDVMPWLQY | (SEQ ID NO: 3710) |
| 236 | GAGSLVDVMP | (SEQ ID NO: 3711) |
| 230 | EFGRTVGAGS | (SEQ ID NO: 3712) |
| 227 | HNEEFGRTVG | (SEQ ID NO: 3713) |
| 220 | EFRELLSHNE | (SEQ ID NO: 3714) |
| 211 | GCRYSHDDPE | (SEQ ID NO: 3715) |
| 207 | AVCFGCRYSH | (SEQ ID NO: 3716) |
| 197 | TVVAVANVMS | (SEQ ID NO: 3717) |
| 179 | ALLVRGSADG | (SEQ ID NO: 3718) |
| 176 | ELVALLVRGS | (SEQ ID NO: 3719) |
| 175 | RELVALLVRG | (SEQ ID NO: 3720) |
| 164 | QVLEGHVLSE | (SEQ ID NO: 3721) |
| 163 | RQVLEGHVLS | (SEQ ID NO: 3722) |
| 158 | RQPRSRQVLE | (SEQ ID NO: 3723) |
| 151 | MMRNFFTRQP | (SEQ ID NO: 3724) |
| 150 | SMMRNFFTRQ | (SEQ ID NO: 3725) |
| 145 | RRAAHSMMRN | (SEQ ID NO: 3726) |
| 144 | QRRAAHSMMR | (SEQ ID NO: 3727) |
| 140 | HWKVQRRAAH | (SEQ ID NO: 3728) |
| 133 | AFGHYSEHWK | (SEQ ID NO: 3729) |
| 130 | RSMAFGHYSE | (SEQ ID NO: 3730) |
| 128 | GGRSMAFGHY | (SEQ ID NO: 3731) |
| 120 | FASFRVVSGG | (SEQ ID NO: 3732) |
| 82 | GDVFQIRLGS | (SEQ ID NO: 3733) |
| 74 | FARLARRYGD | (SEQ ID NO: 3734) |
| 71 | HLSFARLARR | (SEQ ID NO: 3735) |
| 67 | GQAAHLSFAR | (SEQ ID NO: 3736) |
| 59 | LIGNAAAVGQ | (SEQ ID NO: 3737) |
| 49 | SAPPGPFAWP | (SEQ ID NO: 3738) |
| 44 | RRQLRSAPPG | (SEQ ID NO: 3739) |
| 39 | LLRQRRRQLR | (SEQ ID NO: 3740) |
| 32 | TVHVGQRLLR | (SEQ ID NO: 3741) |
| 28 | SVLATVHVGQ | (SEQ ID NO: 3742) |
| 2 | GTSLSPNDPW | (SEQ ID NO: 3743) |
| 530 | DSAVQNLQAK | (SEQ ID NO: 3744) |
| 526 | MELLDSAVQN | (SEQ ID NO: 3745) |
| 315 | LDLENVPA | (SEQ ID NO: 3746) |
| 281 | ESLRPGAA | (SEQ ID NO: 3747) |
| 278 | RHCESLRP | (SEQ ID NO: 3748) |
| 260 | EFEQLNRN | (SEQ ID NO: 3749) |
| 259 | REFEQLNR | (SEQ ID NO: 3750) |
| 238 | GSLVDVMP | (SEQ ID NO: 3751) |
| 232 | GRTVGAGS | (SEQ ID NO: 3752) |
| 230 | EFGRTVGA | (SEQ ID NO: 3753) |
| 221 | FRELLSHN | (SEQ ID NO: 3754) |
| 215 | SHDDPEFR | (SEQ ID NO: 3755) |
| 198 | VVAVANVM | (SEQ ID NO: 3756) |
| 172 | SEARELVA | (SEQ ID NO: 3757) |
| 168 | GHVLSEAR | (SEQ ID NO: 3758) |
| 150 | SMMRNFFT | (SEQ ID NO: 3759) |
| 139 | EHWKVQRR | (SEQ ID NO: 3760) |
| 134 | FGHYSEHW | (SEQ ID NO: 3761) |
| 131 | SMAFGHYS | (SEQ ID NO: 3762) |
| 123 | FRVVSGGR | (SEQ ID NO: 3763) |
| 104 | HQALVQQG | (SEQ ID NO: 3764) |
| 94 | IVVLNGER | (SEQ ID NO: 3765) |
| 73 | SFARLARR | (SEQ ID NO: 3766) |
| 28 | SVLATVHV | (SEQ ID NO: 3767) |
| 2 | GTSLSPND | (SEQ ID NO: 3768) |
| 530 | DSAVQNLQ | (SEQ ID NO: 3769) |
| 526 | MELLDSAV | (SEQ ID NO: 3770) |
| 520 | VTLRESME | (SEQ ID NO: 3771) |
| 518 | VNVTLRES | (SEQ ID NO: 3772) |
| 517 | KVNVTLRE | (SEQ ID NO: 3773) |
| 516 | FKVNVTLR | (SEQ ID NO: 3774) |
| 511 | IKPKSFKV | (SEQ ID NO: 3775) |
| 505 | FSYGLTLK | (SEQ ID NO: 3776) |
| 493 | FRANPNEP | (SEQ ID NO: 3777) |
| 489 | HQCDFRAN | (SEQ ID NO: 3778) |
| 460 | VMIFSVGK | (SEQ ID NO: 3779) |
| 453 | NKDLTSRV | (SEQ ID NO: 3780) |
| 448 | KDGLINKD | (SEQ ID NO: 3781) |
| 491 | CDFRANPEP | (SEQ ID NO: 3782) |
| 488 | AHQCDFRANP | (SEQ ID NO: 3783) |
| 484 | ISILAHQCDF | (SEQ ID NO: 3784) |
| 449 | DGLINKDLTS | (SEQ ID NO: 3785) |
| 444 | RFLDKDGLIN | (SEQ ID NO: 3786) |
| 430 | DPLKWPNPEN | (SEQ ID NO: 3787) |
| 391 | FSSFVPVTIP | (SEQ ID NO: 3788) |
| 378 | LPYVLAFLYE | (SEQ ID NO: 3789) |
| 331 | SQDTLSTALQ | (SEQ ID NO: 3790) |
| 319 | NVPATLTDLF | (SEQ ID NO: 3791) |
| 310 | GGGARLDLEN | (SEQ ID NO: 3792) |
| 284 | RPGAAPRDMM | (SEQ ID NO: 3793) |
| 279 | HCESLRPGAA | (SEQ ID NO: 3794) |
| 258 | FREFEQLNRN | (SEQ ID NO: 3795) |

-continued

| | | |
|---|---|---|
| 257 | VFREFEQLNR | (SEQ ID NO: 3796) |
| 222 | RELLSHNEEF | (SEQ ID NO: 3797) |
| 218 | DPEFRELLSH | (SEQ ID NO: 3798) |
| 212 | CRYSHDDPEF | (SEQ ID NO: 3799) |
| 208 | VCFGCRYSHD | (SEQ ID NO: 3800) |
| 136 | HYSEHWKVQR | (SEQ ID NO: 3801) |
| 130 | RSMAFGHYSE | (SEQ ID NO: 3802) |
| 121 | ASFRVVSGGR | (SEQ ID NO: 3803) |
| 118 | PAFASFRVVS | (SEQ ID NO: 3804) |
| 115 | ADRPAFASFR | (SEQ ID NO: 3805) |
| 111 | GSAFADRPAF | (SEQ ID NO: 3806) |
| 110 | QGSAFADRPA | (SEQ ID NO: 3807) |
| 92 | CPIVVLNGER | (SEQ ID NO: 3808) |
| 73 | SFARLARRYG | (SEQ ID NO: 3809) |
| 67 | GQAAHLSFAR | (SEQ ID NO: 3810) |
| 45 | RQLRSAPPGP | (SEQ ID NO: 3811) |
| 19 | QQTTLLLLLS | (SEQ ID NO: 3812) |
| 496 | NPNEPAKMNF | (SEQ ID NO: 3813) |
| 492 | DFRANPNEPA | (SEQ ID NO: 3814) |
| 468 | RRCIGEELSK | (SEQ ID NO: 3815) |
| 463 | FSVGKRRCIG | (SEQ ID NO: 3816) |
| 439 | NFDPARFLDK | (SEQ ID NO: 3817) |
| 428 | NHDPLKWPNP | (SEQ ID NO: 3818) |
| 425 | WSVNHDPLKW | (SEQ ID NO: 3819) |
| 420 | VFVNQWSVNH | (SEQ ID NO: 3820) |
| 417 | DTVVFVNQWS | (SEQ ID NO: 3821) |
| 392 | SSFVPVTIPH | (SEQ ID NO: 3822) |
| 385 | LYEAMRFSSF | (SEQ ID NO: 3823) |
| 383 | AFLYEAMRFS | (SEQ ID NO: 3824) |
| 367 | DRLPCMGDQP | (SEQ ID NO: 3825) |
| 320 | VPATLTDLFG | (SEQ ID NO: 3826) |
| 305 | AGDSHGGGAR | (SEQ ID NO: 3827) |
| 300 | AEKKAAGDSH | (SEQ ID NO: 3828) |
| 280 | CESLRPGAAP | (SEQ ID NO: 3829) |
| 275 | KFLRHCESLR | (SEQ ID NO: 3830) |
| 47 | LRSAPPGPFA | (SEQ ID NO: 3831) |
| 46 | QLRSAPPGPF | (SEQ ID NO: 3832) |
| 42 | QRRRQLRSAP | (SEQ ID NO: 3833) |
| 37 | QRLLRQRRRQ | (SEQ ID NO: 3834) |
| 30 | LATVHVGQRL | (SEQ ID NO: 3835) |
| 26 | LLSVLATVHV | (SEQ ID NO: 3836) |
| 24 | LLLLSVLATV | (SEQ ID NO: 3837) |
| 242 | DVMPWLQYF | (SEQ ID NO: 3838) |
| 455 | DLTSRVMIF | (SEQ ID NO: 3839) |
| 470 | CIGEELSKM | (SEQ ID NO: 3840) |
| 223 | ELLSHNEEF | (SEQ ID NO: 3841) |
| 260 | EFEQLNRNF | (SEQ ID NO: 3842) |
| 256 | TVFREFEQL | (SEQ ID NO: 3843) |
| 253 | PVRTVFREF | (SEQ ID NO: 3844) |
| 528 | LLDSAVQNL | (SEQ ID NO: 3845) |
| 341 | WLLLLFTRY | (SEQ ID NO: 3846) |
| 263 | QLaNRNFSNF | (SEQ ID NO: 3847) |
| 521 | TLRESMELL | (SEQ ID NO: 3848) |
| 479 | QLFLFLSLL | (SEQ ID NO: 3849) |
| 474 | ELSKMQLFL | (SEQ ID NO: 3850) |
| 473 | EELSKMQLF | (SEQ ID NO: 3851) |
| 413 | HIPKDTVVF | (SEQ ID NO: 3852) |
| 381 | VLAFLYEAM | (SEQ ID NO: 3853) |
| 338 | ALQWLLLLF | (SEQ ID NO: 3854) |
| 377 | NLPYVLAFL | (SEQ ID NO: 3855) |
| 351 | DVQTRVQAE | (SEQ ID NO: 3856) |
| 239 | SLVDVMPWL | (SEQ ID NO: 3857) |
| 173 | EARELVALL | (SEQ ID NO: 3858) |
| 106 | ALVQQGSAF | (SEQ ID NO: 3859) |
| 22 | TLLLLLSVL | (SEQ ID NO: 3860) |
| 417 | DTVVFVNQW | (SEQ ID NO: 3861) |
| 359 | ELDQVVGRD | (SEQ ID NO: 3862) |
| 334 | TLSTALQWL | (SEQ ID NO: 3863) |
| 326 | DIFGASQDT | (SEQ ID NO: 3864) |
| 220 | EFRELLSHN | (SEQ ID NO: 3865) |
| 176 | ELVALLVRG | (SEQ ID NO: 3866) |
| 520 | VTLRESMEL | (SEQ ID NO: 3867) |
| 508 | GLTIKPKSF | (SEQ ID NO: 3868) |
| 485 | SILAHQCDF | (SEQ ID NO: 3869) |
| 336 | STALQWLLL | (SEQ ID NO: 3870) |
| 169 | HVLSEAREL | (SEQ ID NO: 3871) |
| 124 | RVVSGGRSM | (SEQ ID NO: 3872) |
| 83 | DVFQIRLGSI | (SEQ ID NO: 3873) |
| 31 | ATVHVGQRL | (SEQ ID NO: 3874) |
| 499 | EPAKMNFSYI | (SEQ ID NO: 3875) |
| 525 | SMELLDSAVQ | (SEQ ID NO: 3876) |
| 522 | LRESMELLDS | (SEQ ID NO: 3877) |
| 506 | SYGLTIKPKS | (SEQ ID NO: 3878) |
| 497 | PNEPAKMNFS | (SEQ ID NO: 3879) |
| 495 | ANPNEPAKMN | (SEQ ID NO: 3880) |
| 490 | QCDFRANPNE | (SEQ ID NO: 3881) |
| 487 | LAHQCDFRAN | (SEQ ID NO: 3882) |
| 485 | SILAHQCDFR | (SEQ ID NO: 3883) |
| 483 | FLSLLAHQCD | (SEQ ID NO: 3884) |
| 464 | SVGKRRCIGE | (SEQ ID NO: 3885) |
| 458 | SRVMIFSVGK | (SEQ ID NO: 3886) |
| 449 | DGLINKDLTS | (SEQ ID NO: 3887) |
| 445 | FLDKDGLINK | (SEQ ID NO: 3888) |
| 438 | ENFDPARFLD | (SEQ ID NO: 3889) |
| 435 | PNENFDPAR | (SEQ ID NO: 3890) |
| 432 | LKWPNPENFD | (SEQ ID NO: 3891) |
| 425 | WSVNHDPLKW | (SEQ ID NO: 3892) |
| 420 | VFVNQWSVNH | (SEQ ID NO: 3893) |
| 416 | KDTVVFVNQW | (SEQ ID NO: 3894) |
| 406 | NTSVLGYHIP | (SEQ ID NO: 3895) |
| 392 | SSFVPVTIPH | (SEQ ID NO: 3896) |
| 381 | VLAFLYEAMR | (SEQ ID NO: 3897) |
| 368 | RLPCMGDQPN | (SEQ ID NO: 3898) |
| 364 | VGRDRLPCMG | (SEQ ID NO: 3899) |
| 359 | ELDQVVGRDR | (SEQ ID NO: 3900) |
| 350 | PDVQTRVQAE | (SEQ ID NO: 3901) |
| 342 | LLLLFTRYPD | (SEQ ID NO: 3902) |
| 340 | QWLLLLFTRY | (SEQ ID NO: 3903) |
| 332 | QDTLSTALQW | (SEQ ID NO: 3904) |
| 324 | ITDIFGASQD | (SEQ ID NO: 3905) |
| 307 | DSHGGGARLD | (SEQ ID NO: 3906) |
| 301 | EKKAAGDSHG | (SEQ ID NO: 3907) |
| 298 | LSAEKKAAGD | (SEQ ID NO: 3908) |
| 293 | MDAFILSAEK | (SEQ ID NO: 3909) |
| 285 | PGAAPRDMMD | (SEQ ID NO: 3910) |
| 246 | WLQYFPNPVR | (SEQ ID NO: 3911) |
| 224 | LLSHNEEFGR | (SEQ ID NO: 3912) |
| 223 | ELLSHNEEFG | (SEQ ID NO: 3913) |
| 217 | DDPEFRELLS | (SEQ ID NO: 3914) |
| 208 | VCFGCRYSHD | (SEQ ID NO: 3915) |
| 167 | EGHVLSEARE | (SEQ ID NO: 3916) |
| 166 | LEGHVLSEAR | (SEQ ID NO: 3917) |
| 160 | PRSRQVLEGH | (SEQ ID NO: 3918) |
| 153 | RNFFTRQPRS | (SEQ ID NO: 3919) |
| 152 | MRNFFTRQPR | (SEQ ID NO: 3920) |
| 149 | HSMMRNFFTR | (SEQ ID NO: 3921) |
| 132 | MAFGHYSEHW | (SEQ ID NO: 3922) |
| 129 | GRSMAFGHYS | (SEQ ID NO: 3923) |
| 122 | SFRVVSGGRS | (SEQ ID NO: 3924) |
| 443 | ARFLDKDG | (SEQ ID NO: 3925) |
| 427 | VNHDPLKW | (SEQ ID NO: 3926) |
| 424 | QWSVNHDP | (SEQ ID NO: 3927) |
| 422 | VNQWSVNH | (SEQ ID NO: 3928) |
| 421 | FVNQWSVN | (SEQ ID NO: 3929) |
| 420 | VFVNQWSV | (SEQ ID NO: 3930) |
| 417 | DTVVFVNQ | (SEQ ID NO: 3931) |
| 416 | KDTVVFVN | (SEQ ID NO: 3932) |
| 411 | GYHIPKDT | (SEQ ID NO: 3933) |
| 406 | NTSVLGYH | (SEQ ID NO: 3934) |
| 397 | VTIPHATT | (SEQ ID NO: 3935) |
| 391 | FSSFVPVT | (SEQ ID NO: 3936) |
| 383 | AFLYEAMR | (SEQ ID NO: 3937) |
| 379 | PYVLAFLY | (SEQ ID NO: 3938) |
| 373 | GDQPNLPY | (SEQ ID NO: 3939) |
| 365 | GRDRLPCM | (SEQ ID NO: 3940) |
| 363 | VVGRDRLP | (SEQ ID NO: 3941) |
| 361 | DQVVGRDR | (SEQ ID NO: 3942) |
| 360 | LDQVVGRD | (SEQ ID NO: 3943) |
| 352 | VQTRVQAE | (SEQ ID NO: 3944) |
| 340 | QWLLLLFT | (SEQ ID NO: 3945) |
| 327 | IFGASQDT | (SEQ ID NO: 3946) |
| 324 | ITDIFGAS | (SEQ ID NO: 3947) |
| 311 | GGARLDLE | (SEQ ID NO: 3948) |
| 309 | HGGGARLD | (SEQ ID NO: 3949) |
| 306 | GDSHGGGA | (SEQ ID NO: 3950) |
| 295 | AFILSAEK | (SEQ ID NO: 3951) |
| 279 | HCESLRPG | (SEQ ID NO: 3952) |
| 268 | FSNFLLDK | (SEQ ID NO: 3953) |

| | | |
|---|---|---|
| 258 | FREFEQLN | (SEQ ID NO: 3954) |
| 241 | VDVMPWLQ | (SEQ ID NO: 3955) |
| 237 | AGSLVDVM | (SEQ ID NO: 3956) |
| 235 | VGAGSLVD | (SEQ ID NO: 3957) |
| 222 | RELLSHNE | (SEQ ID NO: 3958) |
| 216 | HDDPEFRE | (SEQ ID NO: 3959) |
| 210 | FGCRYSHD | (SEQ ID NO: 3960) |
| 208 | VCFGCRYS | (SEQ ID NO: 3961) |
| 205 | MSAVCFGC | (SEQ ID NO: 3962) |
| 204 | VMSAVCFG | (SEQ ID NO: 3963) |
| 196 | LTVVAVAN | (SEQ ID NO: 3964) |
| 193 | PRPLTVVA | (SEQ ID NO: 3965) |
| 182 | VRGSADGA | (SEQ ID NO: 3966) |
| 177 | LVALLVRG | (SEQ ID NO: 3967) |
| 175 | RELVALLV | (SEQ ID NO: 3968) |
| 169 | HVLSEARE | (SEQ ID NO: 3969) |
| 163 | RQVLEGHV | (SEQ ID NO: 3970) |
| 155 | FFTRQPRS | (SEQ ID NO: 3971) |
| 135 | GHYSEHWK | (SEQ ID NO: 3972) |
| 129 | GRSMAFGH | (SEQ ID NO: 3973) |
| 270 | NFILDKFLRH | (SEQ ID NO: 3974) |
| 269 | SNFILDKFLR | (SEQ ID NO: 3975) |
| 261 | FEQLNRNFSN | (SEQ ID NO: 3976) |
| 259 | REFEQLNRNF | (SEQ ID NO: 3977) |
| 221 | FRELLSHNEE | (SEQ ID NO: 3978) |
| 214 | YSHDDPEFRE | (SEQ ID NO: 3979) |
| 186 | ADGAFLDPRP | (SEQ ID NO: 3980) |
| 166 | LEGHVLSEAR | (SEQ ID NO: 3981) |
| 154 | NFFTRQPRSR | (SEQ ID NO: 3982) |
| 149 | HSMMRNFFTR | (SEQ ID NO: 3983) |
| 139 | EHWKVQRRAA | (SEQ ID NO: 3984) |
| 133 | AFGHYSEHWK | (SEQ ID NO: 3985) |
| 127 | SGGRSMAFGH | (SEQ ID NO: 3986) |
| 103 | IHQALVQQGS | (SEQ ID NO: 3987) |
| 79 | RRYGDVFQIR | (SEQ ID NO: 3988) |
| 72 | LSFARLARRY | (SEQ ID NO: 3989) |
| 40 | LRQRRRQLRS | (SEQ ID NO: 3990) |
| 5 | LSPNDPWPLN | (SEQ ID NO: 3991) |
| 3 | TSLSPNDPWP | (SEQ ID NO: 3992) |
| 534 | QNLQAKETCQ | (SEQ ID NO: 3993) |
| 515 | SFKVNVTLRE | (SEQ ID NO: 3994) |
| 498 | NEPAKMNFSY | (SEQ ID NO: 3995) |
| 489 | HQCDFRANPN | (SEQ ID NO: 3996) |
| 427 | VNHDPLKWPN | (SEQ ID NO: 3997) |
| 422 | VNQWSVNHDP | (SEQ ID NO: 3998) |
| 387 | EAMRFSSFVP | (SEQ ID NO: 3999) |
| 365 | GRDRLPCMGD | (SEQ ID NO: 4000) |
| 364 | VGRDRLPCMG | (SEQ ID NO: 4001) |
| 350 | PDVQTRVQAE | (SEQ ID NO: 4002) |
| 340 | QWLLLLFTRY | (SEQ ID NO: 4003) |
| 327 | IFGASQDTLS | (SEQ ID NO: 4004) |
| 273 | LDKFLRHCES | (SEQ ID NO: 4005) |
| 254 | VRTVFREFEQ | (SEQ ID NO: 4006) |
| 252 | NPVRTVFREF | (SEQ ID NO: 4007) |
| 249 | YFPNPVRTVF | (SEQ ID NO: 4008) |
| 244 | MPWLQYFPNP | (SEQ ID NO: 4009) |
| 219 | PEFRELLSHN | (SEQ ID NO: 4010) |
| 217 | DDPEFRELLS | (SEQ ID NO: 4011) |
| 205 | MSAVCFGCRY | (SEQ ID NO: 4012) |
| 163 | RQVLEGHVLS | (SEQ ID NO: 4013) |
| 160 | PRSRQVLEGH | (SEQ ID NO: 4014) |
| 158 | RQPRSRQVLE | (SEQ ID NO: 4015) |
| 145 | RRAAHSMMRN | (SEQ ID NO: 4016) |
| 141 | WKVQRRAAHS | (SEQ ID NO: 4017) |
| 140 | HWKVQRRAAH | (SEQ ID NO: 4018) |
| 129 | GRSMAFGHYS | (SEQ ID NO: 4019) |
| 122 | SFRVVSGGRS | (SEQ ID NO: 4020) |
| 82 | GDVFQIRLGS | (SEQ ID NO: 4021) |
| 402 | ATTANTSVL | (SEQ ID NO: 4022) |
| 73 | SFARLARRY | (SEQ ID NO: 4023) |
| 17 | SIQQTTLLL | (SEQ ID NO: 4024) |
| 527 | ELLDSAVQIJ | (SEQ ID NO: 4025) |
| 383 | AFLYEAMRF | (SEQ ID NO: 4026) |
| 333 | DTLSTALQW | (SEQ ID NO: 4027) |
| 307 | DSHGGGARL | (SEQ ID NO: 4028) |
| 197 | TVVAVANVM | (SEQ ID NO: 4029) |
| 115 | ADRPAFASF | (SEQ ID NO: 4030) |
| 39 | LLRQRRRQL | (SEQ ID NO: 4031) |
| 32 | TVHVGQRLL | (SEQ ID NO: 4032) |
| 438 | ENFDPARFL | (SEQ ID NO: 4033) |
| 394 | FVPVTIPHA | (SEQ ID NO: 4034) |
| 386 | YEAMRFSSF | (SEQ ID NO: 4035) |
| 376 | PNLPYVLAF | (SEQ ID NO: 4036) |
| 322 | ATLTDLFGA | (SEQ ID NO: 4037) |
| 271 | FILDKFLRH | (SEQ ID NO: 4038) |
| 230 | EFGRTVGAG | (SEQ ID NO: 4039) |
| 217 | DDPEFRELL | (SEQ ID NO: 4040) |
| 200 | AVANVMSAV | (SEQ ID NO: 4041) |
| 177 | LVALLVRGS | (SEQ ID NO: 4042) |
| 102 | AIHQALVQQ | (SEQ ID NO: 4043) |
| 15 | PLSIQQTTL | (SEQ ID NO: 4044) |
| 481 | FLFLSLLAH | (SEQ ID NO: 4045) |
| 475 | LSKMQLFLF | (SEQ ID NO: 4046) |
| 451 | LINKDLTSR | (SEQ ID NO: 4047) |
| 404 | TANTSVLGY | (SEQ ID NO: 4048) |
| 374 | DQPNLPYVL | (SEQ ID NO: 4049) |
| 323 | TITDIFGAS | (SEQ ID NO: 4050) |
| 288 | APRDMMDAF | (SEQ ID NO: 4051) |
| 216 | HDDPEFREL | (SEQ ID NO: 4052) |
| 196 | LTVVAVANV | (SEQ ID NO: 4053) |
| 147 | AAHSMMRNF | (SEQ ID NO: 4054) |
| 34 | HVGQRLLRQ | (SEQ ID NO: 4055) |
| 21 | TTLLLLLSV | (SEQ ID NO: 4056) |
| 517 | KVNVTLRES | (SEQ ID NO: 4057) |
| 510 | TIKPKSFKV | (SEQ ID NO: 4058) |
| 482 | LFLSLLAHQ | (SEQ ID NO: 4059) |
| 447 | DKDGLINKD | (SEQ ID NO: 4060) |
| 380 | YVLAFLYEA | (SEQ ID NO: 4061) |
| 361 | DQVVGRDRL | (SEQ ID NO: 4062) |
| 355 | RVQAELDQV | (SEQ ID NO: 4063) |
| 344 | LLFTRYPDV | (SEQ ID NO: 4064) |
| 327 | IFGASQDTL | (SEQ ID NO: 4065) |
| 319 | NVPATLTDL | (SEQ ID NO: 4066) |
| 316 | DLENVPATI | (SEQ ID NO: 4067) |
| 275 | KFLRHCESL | (SEQ ID NO: 4068) |
| 272 | ILDKFLRHC | (SEQ ID NO: 4069) |
| 121 | ASFRVVSGGR | (SEQ ID NO: 4070) |
| 103 | IHQALVQQGS | (SEQ ID NO: 4071) |
| 96 | VLNGERAIHQ | (SEQ ID NO: 4072) |
| 95 | VVLNGERAIH | (SEQ ID NO: 4073) |
| 73 | SFARLARRYG | (SEQ ID NO: 4074) |
| 52 | PGPFAWPLIG | (SEQ ID NO: 4075) |
| 45 | RQLRSAPPGP | (SEQ ID NO: 4076) |
| 40 | LRQRRRQLRS | (SEQ ID NO: 4077) |
| 36 | GQRLLRQRRR | (SEQ ID NO: 4078) |
| 29 | VLATVHVGQR | (SEQ ID NO: 4079) |
| 27 | LSVLATVHVG | (SEQ ID NO: 4080) |
| 25 | LLLSVLATVH | (SEQ ID NO: 4081) |
| 19 | QQTTLLLLLS | (SEQ ID NO: 4082) |
| 534 | QNLQAKETCQ | (SEQ ID NO: 4083) |
| 531 | SAVQNLQAKE | (SEQ ID NO: 4084) |
| 528 | LLDSAVQNLQ | (SEQ ID NO: 4085) |
| 508 | GLTIKPKSFK | (SEQ ID NO: 4086) |
| 503 | MNFSYGLTIK | (SEQ ID NO: 4087) |
| 498 | NEPAKMNFSY | (SEQ ID NO: 4088) |
| 489 | HQCDFRANPN | (SEQ ID NO: 4089) |
| 481 | FLFLSLLAHQ | (SEQ ID NO: 4090) |
| 476 | SKMQLFLFIS | (SEQ ID NO: 4091) |
| 470 | CIGEELSKMQ | (SEQ ID NO: 4092) |
| 455 | DLTSRVMIFS | (SEQ ID NO: 4093) |
| 450 | GLINKDLTSR | (SEQ ID NO: 4094) |
| 440 | FDPARFLDKD | (SEQ ID NO: 4095) |
| 433 | KWPNPENFDP | (SEQ ID NO: 4096) |
| 429 | HDPLKWPNPE | (SEQ ID NO: 4097) |
| 427 | VNHDPLKWPN | (SEQ ID NO: 4098) |
| 421 | FVNQWSVNHD | (SEQ ID NO: 4099) |
| 419 | VVFVNQWSVN | (SEQ ID NO: 4100) |
| 407 | TSVLGYHIPK | (SEQ ID NO: 4101) |
| 384 | FLYEAMRFSS | (SEQ ID NO: 4102) |
| 367 | DRLPCMGDQP | (SEQ ID NO: 4103) |
| 365 | GRDRLPCMGD | (SEQ ID NO: 4104) |
| 344 | LLFTRYPDVQ | (SEQ ID NO: 4105) |
| 341 | WLLLLFTRYP | (SEQ ID NO: 4106) |
| 323 | TITDIFGASQ | (SEQ ID NO: 4107) |
| 317 | LENVPATITD | (SEQ ID NO: 4108) |
| 299 | SAEKKAAGDS | (SEQ ID NO: 4109) |
| 277 | LRHCESLRPG | (SEQ ID NO: 4110) |
| 275 | KFLRHCESLR | (SEQ ID NO: 4111) |

| | | |
|---|---|---|
| 265 | NRNFSNFILD | (SEQ ID NO: 4112) |
| 251 | PNPVRTVFRE | (SEQ ID NO: 4113) |
| 243 | VMPWLQYFPN | (SEQ ID NO: 4114) |
| 209 | CFGCRYSHDD | (SEQ ID NO: 4115) |
| 203 | NVMSAVCFGC | (SEQ ID NO: 4116) |
| 125 | VVSGGRSM | (SEQ ID NO: 4117) |
| 111 | GSAFADRP | (SEQ ID NO: 4118) |
| 108 | VQQGSAFA | (SEQ ID NO: 4119) |
| 103 | IHQALVQQ | (SEQ ID NO: 4120) |
| 95 | VVLNGERA | (SEQ ID NO: 4121) |
| 85 | FQIRLGSC | (SEQ ID NO: 4122) |
| 81 | YGDVFQIR | (SEQ ID NO: 4123) |
| 66 | VGQAAHLS | (SEQ ID NO: 4124) |
| 61 | GNAAAVGQ | (SEQ ID NO: 4125) |
| 60 | IGNAAAVG | (SEQ ID NO: 4126) |
| 56 | AWPLIGNA | (SEQ ID NO: 4127) |
| 35 | VGQRLLRQ | (SEQ ID NO: 4128) |
| 27 | LSVLATVH | (SEQ ID NO: 4129) |
| 21 | TTLLLLLS | (SEQ ID NO: 4130) |
| 13 | LNPLSIQQ | (SEQ ID NO: 4131) |
| 10 | PWPLNPLS | (SEQ ID NO: 4132) |
| 39 | LLRQRRRQL | (SEQ ID NO: 4133) |
| 173 | EARELVALL | (SEQ ID NO: 4134) |
| 521 | TLRESMELL | (SEQ ID NO: 4135) |
| 510 | TIKPKSFKV | (SEQ ID NO: 4136) |
| 508 | GLTIKPKSF | (SEQ ID NO: 4137) |
| 455 | DLTSRVMIF | (SEQ ID NO: 4138) |
| 159 | QPRSRQVLE | (SEQ ID NO: 4139) |
| 465 | VGKRRCIGE | (SEQ ID NO: 4140) |
| 414 | IPKDTVVFV | (SEQ ID NO: 4141) |
| 288 | APRDMMDAF | (SEQ ID NO: 4142) |
| 479 | QLFLFLSLL | (SEQ ID NO: 4143) |
| 474 | ELSKMQLFL | (SEQ ID NO: 4144) |
| 473 | EELSKMQLF | (SEQ ID NO: 4145) |
| 431 | PLKWPNPEN | (SEQ ID NO: 4146) |
| 239 | SLVDVMPWL | (SEQ ID NO: 4147) |
| 99 | GERAIHQAL | (SEQ ID NO: 4148) |
| 528 | LLDSAVQNL | (SEQ ID NO: 4149) |
| 512 | KPKSFKVNV | (SEQ ID NO: 4150) |
| 467 | KRRCIGEEL | (SEQ ID NO: 4151) |
| 463 | FSVGKRRCI | (SEQ ID NO: 4152) |
| 450 | GLINKDLTS | (SEQ ID NO: 4153) |
| 377 | NLPYVLAFL | (SEQ ID NO: 4154) |
| 86 | QIRLGSCPI | (SEQ ID NO: 4155) |
| 22 | TLLLLLSVL | (SEQ ID NO: 4156) |
| 535 | NLQAKETCQ | (SEQ ID NO: 4157) |
| 475 | LSKMQLFLF | (SEQ ID NO: 4158) |
| 444 | RFLDKDGLI | (SEQ ID NO: 4159) |
| 334 | TLSTALQWL | (SEQ ID NO: 4160) |
| 43 | RRRQLRSAPP | (SEQ ID NO: 4161) |
| 37 | QRLLRORRRQ | (SEQ ID NO: 4162) |
| 11 | WPLNPLSIQQ | (SEQ ID NO: 4163) |
| 518 | VNVTLRESME | (SEQ ID NO: 4164) |
| 504 | NFSYGLTIKP | (SEQ ID NO: 4165) |
| 495 | ANPNEPAKMN | (SEQ ID NO: 4166) |
| 467 | KRRCIGEELS | (SEQ ID NO: 4167) |
| 436 | NPENFDPARF | (SEQ ID NO: 4168) |
| 435 | PNPENFDPAR | (SEQ ID NO: 4169) |
| 433 | KWPNPENFDP | (SEQ ID NO: 4170) |
| 429 | HDPLKWPNPE | (SEQ ID NO: 4171) |
| 424 | QWSVNHDPLK | (SEQ ID NO: 4172) |
| 370 | PCMGDQPNLP | (SEQ ID NO: 4173) |
| 348 | RYPDVQTRVQ | (SEQ ID NO: 4174) |
| 307 | DSHGGGARLD | (SEQ ID NO: 4175) |
| 290 | RDMMDAFILS | (SEQ ID NO: 4176) |
| 281 | ESLRPGAAPR | (SEQ ID NO: 4177) |
| 253 | PVRTVFREFE | (SEQ ID NO: 4178) |
| 251 | PNPVRTVFRE | (SEQ ID NO: 4179) |
| 227 | HNEEFGRTVG | (SEQ ID NO: 4180) |
| 210 | FGCRYSHDDP | (SEQ ID NO: 4181) |
| 209 | CFGCRVSHDO | (SEQ ID NO: 4182) |
| 153 | RNFFTRQPRS | (SEQ ID NO: 4183) |
| 135 | GHYSEHWKVQ | (SEQ ID NO: 4184) |
| 128 | GGRSMAFGHY | (SEQ ID NO: 4185) |
| 84 | VFQIRLGSCP | (SEQ ID NO: 4186) |
| 44 | RROLRSAPPG | (SEQ ID NO: 4187) |
| 42 | QRRQLRSAP | (SEQ ID NO: 4188) |
| 36 | GQRLLRQRRR | (SEQ ID NO: 4189) |
| 35 | VGQRLLRQRR | (SEQ ID NO: 4190) |
| 10 | PWPLNPLSIQ | (SEQ ID NO: 4191) |
| 8 | NDPWPLNPLS | (SEQ ID NO: 4192) |
| 499 | EPAKMNFSYG | (SEQ ID NO: 4193) |
| 497 | PNEPAKMNFS | (SEQ ID NO: 4194) |
| 438 | ENFDPARFLD | (SEQ ID NO: 4195) |
| 415 | PKDTVVFVNQ | (SEQ ID NO: 4196) |
| 361 | DQVVGRDRLP | (SEQ ID NO: 4197) |
| 285 | PGAAPRDMMD | (SEQ ID NO: 4198) |
| 262 | EQLNRNFSNF | (SEQ ID NO: 4199) |
| 167 | EGHVLSEARE | (SEQ ID NO: 4200) |
| 260 | EFEQLNRNFS | (SEQ ID NO: 4201) |
| 52 | PGPFAWPLIG | (SEQ ID NO: 4202) |
| 301 | EKKAAGDSHG | (SEQ ID NO: 4203) |
| 531 | SAVQNLQA | (SEQ ID NO: 4204) |
| 525 | SMELLDSA | (SEQ ID NO: 4205) |
| 494 | RANPNEPA | (SEQ ID NO: 4206) |
| 268 | FSNFILOKF | (SEQ ID NO: 4207) |
| 203 | NVMSAVCFG | (SEQ ID NO: 4208) |
| 172 | SEARELVAL | (SEQ ID NO: 4209) |
| 165 | VLEGHVLSE | (SEQ ID NO: 4210) |
| 129 | GRSMAFGHY | (SEQ ID NO: 4211) |
| 69 | AAHLSFARL | (SEQ ID NO: 4212) |
| 20 | QTTLLLLLS | (SEQ ID NO: 4213) |
| 524 | ESMELLDSA | (SEQ ID NO: 4214) |
| 509 | LTIKPKSFK | (SEQ ID NO: 4215) |
| 497 | PNEPAKMNF | (SEQ ID NO: 4216) |
| 461 | MIFSVGKRR | (SEQ ID NO: 4217) |
| 456 | LTSRVMIFS | (SEQ ID NO: 4218) |
| 409 | VLGYHIPKD | (SEQ ID NO: 4219) |
| 397 | VTIPHATTA | (SEQ ID NO: 4220) |
| 384 | FLYEAMRFS | (SEQ ID NO: 4221) |
| 364 | VGRDRLPCM | (SEQ ID NO: 4222) |
| 236 | GAGSLVDVM | (SEQ ID NO: 4223) |
| 181 | LVRGSADGA | (SEQ ID NO: 4224) |
| 126 | VSGGRSMAF | (SEQ ID NO: 4225) |
| 125 | VVSGGRSMA | (SEQ ID NO: 4226) |
| 112 | SAFADRPAF | (SEQ ID NO: 4227) |
| 58 | PLIGNAAAV | (SEQ ID NO: 4228) |
| 28 | SVLATVHVG | (SEQ ID NO: 4229) |
| 25 | LLLSVLATV | (SEQ ID NO: 4230) |
| 24 | LLLLSVLAT | (SEQ ID NO: 4231) |
| 532 | AVQNLQAKE | (SEQ ID NO: 4232) |
| 492 | DFRANPNEP | (SEQ ID NO: 4233) |
| 432 | LKWPNPENF | (SEQ ID NO: 4234) |
| 421 | FVNQWSVNH | (SEQ ID NO: 4235) |
| 419 | VVFVNQWSV | (SEQ ID NO: 4236) |
| 337 | TALQWLLLI | (SEQ ID NO: 4237) |
| 324 | ITDIFGASQ | (SEQ ID NO: 4238) |
| 233 | RTVGAGSLV | (SEQ ID NO: 4239) |
| 198 | VVAVANVMS | (SEQ ID NO: 4240) |
| 164 | QVLEGHVLS | (SEQ ID NO: 4241) |
| 156 | FTRQPRSRQ | (SEQ ID NO: 4242) |
| 89 | LGSCPIVVL | (SEQ ID NO: 4243) |
| 76 | RLARRYGDV | (SEQ ID NO: 4244) |
| 64 | AAVGQAAHL | (SEQ ID NO: 4245) |
| 19 | QQTTLLLLL | (SEQ ID NO: 4246) |
| 8 | NDPWPLNPL | (SEQ ID NO: 4247) |
| 519 | NVTLRESME | (SEQ ID NO: 4248) |
| 514 | KSFKVNVTL | (SEQ ID NO: 4249) |
| 483 | FISILAHQC | (SEQ ID NO: 4250) |
| 459 | RVMIFSVGK | (SEQ ID NO: 4251) |
| 441 | DPARFLDKD | (SEQ ID NO: 4252) |
| 437 | PENFDPARF | (SEQ ID NO: 4253) |
| 408 | SVLGYHIPK | (SEQ ID NO: 4254) |
| 406 | NTSVLGYHI | (SEQ ID NO: 4255) |
| 403 | TTANTSVLG | (SEQ ID NO: 4256) |
| 178 | VALLVRGSAD | (SEQ ID NO: 4257) |
| 155 | FFTROPRSRQ | (SEQ ID NO: 4258) |
| 141 | WKVORRAAHS | (SEQ ID NO: 4259) |
| 137 | YSEHWKVQRR | (SEQ ID NO: 4260) |
| 135 | GHYSEHWKVQ | (SEQ ID NO: 4261) |
| 131 | SMAFGHYSEH | (SEQ ID NO: 4262) |
| 127 | SGGRSMAFGH | (SEQ ID NO: 4263) |
| 109 | QQGSAFADRP | (SEQ ID NO: 4264) |
| 107 | LVQQGSAFAD | (SEQ ID NO: 4265) |
| 81 | YGDVFQIRLG | (SEQ ID NO: 4266) |
| 72 | LSFARLARRY | (SEQ ID NO: 4267) |
| 37 | QRLLRQRRRQ | (SEQ ID NO: 4268) |
| 35 | VGQRLLRQRR | (SEQ ID NO: 4269) |

-continued

| | | |
|---|---|---|
| 34 | HVGQRLLRQR | (SEQ ID NO: 4270) |
| 8 | NDPWPLNPLS | (SEQ ID NO: 4271) |
| 5 | LSPNDPWPLN | (SEQ ID NO: 4272) |
| 3 | TSLSPNDPWP | (SEQ ID NO: 4273) |
| 148 | AHSMMRNFF | (SEQ ID NO: 4274) |
| 89 | LGSCPIVVL | (SEQ ID NO: 4275) |
| 139 | EHWKVQRRA | (SEQ ID NO: 4276) |
| 438 | ENFDPARFL | (SEQ ID NO: 4277) |
| 412 | YHIPKDTVV | (SEQ ID NO: 4278) |
| 361 | DQVVGRDRL | (SEQ ID NO: 4279) |
| 216 | HDDPEFREL | (SEQ ID NO: 4280) |
| 32 | TVHVGQRLL | (SEQ ID NO: 4281) |
| 514 | KSFVNVTL | (SEQ ID NO: 4282) |
| 308 | SHGGGARLD | (SEQ ID NO: 4283) |
| 307 | DSHGGGARL | (SEQ ID NO: 4284) |
| 215 | SHDDPEFRE | (SEQ ID NO: 4285) |
| 188 | GAFLDPRPL | (SEQ ID NO: 4286) |
| 172 | SEARELVAL | (SEQ ID NO: 4287) |
| 81 | YGDVFQIRL | (SEQ ID NO: 4288) |
| 39 | LLRQRRRQL | (SEQ ID NO: 4289) |
| 521 | TLRESMELL | (SEQ ID NO: 4290) |
| 488 | AH0CDFRAN | (SEQ ID NO: 4291) |
| 474 | ELSKMQLFL | (SEQ ID NO: 4292) |
| 472 | GEELSKMQL | (SEQ ID NO: 4293) |
| 428 | NHDPLKWPN | (SEQ ID NO: 4294) |
| 424 | QWSVNHDPL | (SEQ ID NO: 4295) |
| 402 | ATTANTSVL | (SEQ ID NO: 4296) |
| 374 | DQPNLPVVL | (SEQ ID NO: 4297) |
| 327 | IFGASQDTL | (SEQ ID NO: 4298) |
| 278 | RHCESLRPG | (SEQ ID NO: 4299) |
| 239 | SLVDVMPWL | (SEQ ID NO: 4300) |
| 232 | GRTVGAGSL | (SEQ ID NO: 4301) |
| 226 | SHNEEFGRT | (SEQ ID NO: 4302) |
| 299 | SAEKKAAGD | (SEQ ID NO: 4303) |
| 223 | ELLSHNEEF | (SEQ ID NO: 4304) |
| 188 | GAFLDPRPL | (SEQ ID NO: 4305) |
| 179 | ALLVRGSAD | (SEQ ID NO: 4306) |
| 126 | VSGGRSMAF | (SEQ ID NO: 4307) |
| 77 | LARRYGDVF | (SEQ ID NO: 4308) |
| 51 | PPGPFAWPL | (SEQ ID NO: 4309) |
| 17 | SIQQTTLLL | (SEQ ID NO: 4310) |
| 15 | PLSIQQTTL | (SEQ ID NO: 4311) |
| 364 | VGRDRLPCM | (SEQ ID NO: 4312) |
| 271 | FILDKFLRH | (SEQ ID NO: 4313) |
| 190 | FLOPRPLTV | (SEQ ID NO: 4314) |
| 120 | FASFRVVSG | (SEQ ID NO: 4315) |
| 69 | AAHLSFARL | (SEQ ID NO: 4316) |
| 515 | SFKVNVTLR | (SEQ ID NO: 4317) |
| 500 | PAKMNFSYG | (SEQ ID NO: 4318) |
| 386 | YEAMRFSSF | (SEQ ID NO: 4319) |
| 344 | LLFTRYPDV | (SEQ ID NO: 4320) |
| 337 | TALQWLLLL | (SEQ ID NO: 4321) |
| 282 | SLRPGAAPR | (SEQ ID NO: 4322) |
| 218 | DPEFRELLS | (SEQ ID NO: 4323) |
| 172 | SEARELVAL | (SEQ ID NO: 4324) |
| 76 | RLARRYGDV | (SEQ ID NO: 4325) |
| 64 | AAVGQAAHL | (SEQ ID NO: 4326) |
| 41 | RQRRRQLRS | (SEQ ID NO: 4327) |
| 448 | KDGLINKDL | (SEQ ID NO: 4328) |
| 336 | STALOWLLL | (SEQ ID NO: 4329) |
| 331 | SQDTLSTAL | (SEQ ID NO: 4330) |
| 320 | VPATITDIF | (SEQ ID NO: 4331) |
| 298 | LSAEKKAAG | (SEQ ID NO: 4332) |
| 286 | GAAPRDMMD | (SEQ ID NO: 4333) |
| 276 | FLRHCESLR | (SEQ ID NO: 4334) |
| 269 | SNFILDKFL | (SEQ ID NO: 4335) |
| 253 | PVRTVFREF | (SEQ ID NO: 4336) |
| 250 | FPNPVRTVF | (SEQ ID NO: 4337) |
| 192 | DPRPLTVVA | (SEQ ID NO: 4338) |
| 140 | HWKVQRRAA | (SEQ ID NO: 4339) |
| 138 | SEHWKVQRR | (SEQ ID NO: 4340) |
| 112 | SAFADRPAF | (SEQ ID NO: 4341) |
| 106 | ALVQQGSAF | (SEQ ID NO: 4342) |
| 520 | VTLRESMEL | (SEQ ID NO: 4343) |
| 514 | KSFVNVTL | (SEQ ID NO: 4344) |
| 485 | SILAHQCDF | (SEQ ID NO: 4345) |
| 472 | GEELSKMQL | (SEQ ID NO: 4346) |
| 438 | ENFDPARFL | (SEQ ID NO: 4347) |
| 429 | HDPLKWPNP | (SEQ ID NO: 4348) |

-continued

| | | |
|---|---|---|
| 413 | HIPKDTVVF | (SEQ ID NO: 4349) |
| 352 | VQTRVQAEL | (SEQ ID NO: 4350) |
| 338 | ALQWLLLLF | (SEQ ID NO: 4351) |
| 316 | DLENVPATI | (SEQ ID NO: 4352) |
| 488 | AHQCDFRA | (SEQ ID NO: 4353) |
| 481 | FLFLSLLA | (SEQ ID NO: 4354) |
| 436 | NPENFDPA | (SEQ ID NO: 4355) |
| 398 | TIPHATTA | (SEQ ID NO: 4356) |
| 395 | VPVTIPHA | (SEQ ID NO: 4357) |
| 381 | VLAFLYEA | (SEQ ID NO: 4358) |
| 376 | PNLPYVLA | (SEQ ID NO: 4359) |
| 351 | DVQTRVQA | (SEQ ID NO: 4360) |
| 331 | SQDTLSTA | (SEQ ID NO: 4361) |
| 323 | TLTDLFGA | (SEQ ID NO: 4362) |
| 315 | LDLENVPA | (SEQ ID NO: 4363) |
| 306 | GDSHGGGA | (SEQ ID NO: 4364) |
| 298 | LSAEKKAA | (SEQ ID NO: 4365) |
| 297 | ILSAEKKA | (SEQ ID NO: 4366) |
| 293 | MDAFILSA | (SEQ ID NO: 4367) |
| 288 | APRDMMDA | (SEQ ID NO: 4368) |
| 281 | ESLRPGAA | (SEQ ID NO: 4369) |
| 280 | CESLRPGA | (SEQ ID NO: 4370) |
| 230 | EFGRTVGA | (SEQ ID NO: 4371) |
| 200 | AVANVMSA | (SEQ ID NO: 4372) |
| 195 | PLTVVAVA | (SEQ ID NO: 4373) |
| 193 | PRPLTVVA | (SEQ ID NO: 4374) |
| 182 | VRGSADGA | (SEQ ID NO: 4375) |
| 179 | ALLVRGSA | (SEQ ID NO: 4376) |
| 172 | SEARELVA | (SEQ ID NO: 4377) |
| 167 | EGHVLSEA | (SEQ ID NO: 4378) |
| 141 | WKVQRRAA | (SEQ ID NO: 4379) |
| 140 | HWKVQRRA | (SEQ ID NO: 4380) |
| 126 | VSGGRSMA | (SEQ ID NO: 4381) |
| 114 | FADRPAFA | (SEQ ID NO: 4382) |
| 112 | SAFADRPA | (SEQ ID NO: 4383) |
| 108 | VQQGSAFA | (SEQ ID NO: 4384) |
| 106 | ALVQQGSA | (SEQ ID NO: 4385) |
| 99 | GERAIHQA | (SEQ ID NO: 4386) |
| 95 | VVLNGERA | (SEQ ID NO: 4387) |
| 71 | HLSFARLA | (SEQ ID NO: 4388) |
| 68 | QAAHLSFA | (SEQ ID NO: 4389) |
| 63 | AAAVGQAA | (SEQ ID NO: 4390) |
| 62 | NAAAVGQA | (SEQ ID NO: 4391) |
| 58 | PLIGNAAA | (SEQ ID NO: 4392) |
| 57 | WPLIGNAA | (SEQ ID NO: 4393) |
| 56 | AWPLIGNA | (SEQ ID NO: 4394) |
| 49 | SAPPGPFA | (SEQ ID NO: 4395) |
| 43 | RRRQLRSA | (SEQ ID NO: 4396) |
| 24 | LLLLSVLA | (SEQ ID NO: 4397) |
| 535 | NLQAKETCQ | (SEQ ID NO: 4398) |
| 529 | LDSAVQNLQ | (SEQ ID NO: 4399) |
| 498 | NEPAKMNFS | (SEQ ID NO: 4400) |
| 492 | DFRANPNEP | (SEQ ID NO: 4401) |
| 485 | SILAHQCDF | (SEQ ID NO: 4402) |
| 440 | FDPARFLDK | (SEQ ID NO: 4403) |
| 402 | ATTANTSVL | (SEQ ID NO: 4404) |
| 399 | IPHATTANT | (SEQ ID NO: 4405) |
| 385 | LYEAMRFSS | (SEQ ID NO: 4406) |
| 398 | TIPHATTAN | (SEQ ID NO: 4407) |
| 390 | RFSSFVPVT | (SEQ ID NO: 4408) |
| 372 | MGDQPNLPY | (SEQ ID NO: 4409) |
| 370 | PCMGDQPNL | (SEQ ID NO: 4410) |
| 367 | DRLPCMGDQ | (SEQ ID NO: 4411) |
| 362 | QVVGRDRLP | (SEQ ID NO: 4412) |
| 346 | FTRYPDVQT | (SEQ ID NO: 4413) |
| 296 | FILSAEKKA | (SEQ ID NO: 4414) |
| 250 | FPNPVRTVF | (SEQ ID NO: 4415) |
| 229 | EEFGRTVGA | (SEQ ID NO: 4416) |
| 213 | RYSHDDPEF | (SEQ ID NO: 4417) |
| 209 | CFGCRYSHD | (SEQ ID NO: 4418) |
| 202 | ANVMSAVCF | (SEQ ID NO: 4419) |
| 182 | VRGSADGAF | (SEQ ID NO: 4420) |
| 142 | KVQRRAAHS | (SEQ ID NO: 4421) |
| 107 | LVQQGSAFA | (SEQ ID NO: 4422) |
| 93 | PIVVLNGER | (SEQ ID NO: 4423) |
| 54 | PFAWPLIGN | (SEQ ID NO: 4424) |
| 18 | IQQTTLLLL | (SEQ ID NO: 4425) |
| 16 | LSIQQTTLL | (SEQ ID NO: 4426) |
| 12 | PLNPLSIQQ | (SEQ ID NO: 4427) |

| | | |
|---|---|---|
| 515 | SFKVNVTLR | (SEQ ID NO: 4428) |
| 495 | ANPNEPAKM | (SEQ ID NO: 4429) |
| 472 | GEELSKMQL | (SEQ ID NO: 4430) |
| 464 | SVGKRRCIG | (SEQ ID NO: 4431) |
| 450 | GLINKDLTS | (SEQ ID NO: 4432) |
| 443 | ARFLDKDGL | (SEQ ID NO: 4433) |
| 431 | PLKWPNPEN | (SEQ ID NO: 4434) |
| 426 | SVNHDPLKW | (SEQ ID NO: 4435) |
| 418 | TVVFVNQWS | (SEQ ID NO: 4436) |
| 396 | PVTIPHATT | (SEQ ID NO: 4437) |
| 378 | LPYVLAFLY | (SEQ ID NO: 4438) |
| 353 | QTRVQAELD | (SEQ ID NO: 4439) |
| 331 | SQDTLSTAL | (SEQ ID NO: 4440) |
| 320 | VPATITDIF | (SEQ ID NO: 4441) |
| 294 | DAFILSAEK | (SEQ ID NO: 4442) |
| 291 | DMMDAFILS | (SEQ ID NO: 4443) |
| 282 | SLRPGAAPR | (SEQ ID NO: 4444) |
| 269 | SNFILDKFL | (SEQ ID NO: 4445) |
| 255 | RTVFREFEQ | (SEQ ID NO: 4446) |
| 249 | YFPNPVRTV | (SEQ ID NO: 4447) |
| 241 | VDVMPWLQY | (SEQ ID NO: 4448) |
| 240 | LVDVMPWLQ | (SEQ ID NO: 4449) |
| 206 | SAVCFGCRY | (SEQ ID NO: 4450) |
| 190 | FLDPRPLTV | (SEQ ID NO: 4451) |
| 158 | RQPRSRQVL | (SEQ ID NO: 4452) |
| 96 | VLNGERAIH | (SEQ ID NO: 4453) |
| 95 | VVLNGERAI | (SEQ ID NO: 4454) |
| 94 | IVVLNGER/r | (SEQ ID NO: 4455) |
| 84 | VFQIRLGSC | (SEQ ID NO: 4456) |
| 66 | VGQAAHLSF | (SEQ ID NO: 4457) |
| 65 | AVGQAAHLS | (SEQ ID NO: 4458) |
| 59 | LIGNAAAVG | (SEQ ID NO: 4459) |
| 46 | QLRSAPPGP | (SEQ ID NO: 4460) |
| 29 | VLATVHVGQ | (SEQ ID NO: 4461) |
| 4 | SLSPNDPWP | (SEQ ID NO: 4462) |
| 2 | GTSLSPNDP | (SEQ ID NO: 4463) |
| 518 | VNVTLRESM | (SEQ ID NO: 4464) |
| 173 | EARELVALL | (SEQ ID NO: 4465) |
| 169 | HVLSEAREL | (SEQ ID NO: 4466) |
| 168 | GHVLSEARE | (SEQ ID NO: 4467) |
| 158 | RQPRSRQVL | (SEQ ID NO: 4468) |
| 103 | IHQALVQQG | (SEQ ID NO: 4469) |
| 22 | TLLLLLSVL | (SEQ ID NO: 4470) |
| 400 | PHATTANTS | (SEQ ID NO: 4471) |
| 370 | PCMGDQPNL | (SEQ ID NO: 4472) |
| 337 | TALQWLLLL | (SEQ ID NO: 4473) |
| 334 | TLSTALQWL | (SEQ ID NO: 4474) |
| 309 | HGGGARLDL | (SEQ ID NO: 4475) |
| 217 | DDPEFRELL | (SEQ ID NO: 4476) |
| 163 | RQVLEGHVL | (SEQ ID NO: 4477) |
| 99 | GERAIHQAL | (SEQ ID NO: 4478) |
| 70 | AHLSFARLA | (SEQ ID NO: 4479) |
| 69 | AAHLSFARL | (SEQ ID NO: 4480) |
| 51 | PPGPFAWPL | (SEQ ID NO: 4481) |
| 33 | VHVGQRLLR | (SEQ ID NO: 4482) |
| 31 | ATVHVGQRL | (SEQ ID NO: 4483) |
| 18 | IQQTTLLLL | (SEQ ID NO: 4484) |
| 15 | PLSIQQTTL | (SEQ ID NO: 4485) |
| 528 | LLDSAVQNL | (SEQ ID NO: 4486) |
| 520 | VTLRESMEL | (SEQ ID NO: 4487) |
| 479 | QLFLFISIL | (SEQ ID NO: 4488) |
| 467 | KRRCIGEEL | (SEQ ID NO: 4489) |
| 443 | ARFLDKDGL | (SEQ ID NO: 4490) |
| 413 | HIPKDTVVF | (SEQ ID NO: 4491) |
| 352 | VQTRVQAEL | (SEQ ID NO: 4492) |
| 336 | STALQWLLL | (SEQ ID NO: 4493) |
| 331 | SQDTLSTAL | (SEQ ID NO: 4494) |
| 260 | EFEQLNRNF | (SEQ ID NO: 4495) |
| 256 | TVFREFEQL | (SEQ ID NO: 4496) |
| 250 | FPNPVRTVF | (SEQ ID NO: 4497) |
| 183 | RGSADGAFL | (SEQ ID NO: 4498) |
| 135 | GHYSEHWKV | (SEQ ID NO: 4499) |
| 64 | AAVGQAAHL | (SEQ ID NO: 4500) |
| 17 | SIQQTTLLL | (SEQ ID NO: 4501) |
| 16 | LSIQQTTLL | (SEQ ID NO: 4502) |
| 8 | NDPWPLNPL | (SEQ ID NO: 4503) |
| 5 | LSPNDPWPL | (SEQ ID NO: 4504) |
| 501 | AKMNFSYGL | (SEQ ID NO: 4505) |
| 497 | PNEPAKMNF | (SEQ ID NO: 4506) |
| 462 | IFSVGKRRC | (SEQ ID NO: 4507) |
| 453 | NKDLTSRVM | (SEQ ID NO: 4508) |
| 448 | KDGLINKDL | (SEQ ID NO: 4509) |
| 432 | LKWPNPENF | (SEQ ID NO: 4510) |
| 377 | NLPYVLAFL | (SEQ ID NO: 4511) |
| 376 | PNLPYVLAF | (SEQ ID NO: 4512) |
| 335 | LSTALQWLL | (SEQ ID NO: 4513) |
| 290 | RDMMDAFIL | (SEQ ID NO: 4514) |
| 275 | KFLRHCESL | (SEQ ID NO: 4515) |
| 269 | SNFILDKFL | (SEQ ID NO: 4516) |
| 265 | NRNFSNFIL | (SEQ ID NO: 4517) |
| 236 | GAGSLVDVM | (SEQ ID NO: 4518) |
| 19 | QQTTLLLLL | (SEQ ID NO: 4519) |
| 437 | PENFDPARF | (SEQ ID NO: 4520) |
| 288 | APRDMMDAF | (SEQ ID NO: 4521) |
| 285 | PGAAPRDMM | (SEQ ID NO: 4522) |
| 312 | GARLDLENV | (SEQ ID NO: 4523) |
| 301 | EKKAAGDSH | (SEQ ID NO: 4524) |
| 264 | LNRNFSNFI | (SEQ ID NO: 4525) |
| 263 | QLNRNFSNF | (SEQ ID NO: 4526) |
| 232 | GRTVGAGSL | (SEQ ID NO: 4527) |
| 217 | DDPEFRELL | (SEQ ID NO: 4528) |
| 216 | HDDPEFREL | (SEQ ID NO: 4529) |
| 169 | HVLSEAREL | (SEQ ID NO: 4530) |
| 115 | ADRPAFASF | (SEQ ID NO: 4531) |
| 89 | LGSCPIVVL | (SEQ ID NO: 4532) |
| 74 | FARLARRYG | (SEQ ID NO: 4533) |
| 46 | QLRSAPPGP | (SEQ ID NO: 4534) |
| 513 | PKSFKVNVT | (SEQ ID NO: 4535) |
| 452 | INKDLTSRV | (SEQ ID NO: 4536) |
| 443 | ARFLDKDGL | (SEQ ID NO: 4537) |
| 442 | PARFLDKDG | (SEQ ID NO: 4538) |
| 424 | QWSVNHDPL | (SEQ ID NO: 4539) |
| 361 | DQVVGRDRL | (SEQ ID NO: 4540) |
| 327 | IFGASQDTL | (SEQ ID NO: 4541) |
| 309 | HGGGARLDL | (SEQ ID NO: 4542) |
| 265 | NRN-FSNFIL | (SEQ ID NO: 4543) |
| 262 | EQLNRNFSN | (SEQ ID NO: 4544) |
| 229 | EEFGRTVGA | (SEQ ID NO: 4545) |
| 163 | RQVLEGHVL | (SEQ ID NO: 4546) |
| 81 | YGDVFQIRL | (SEQ ID NO: 4547) |
| 32 | TVHVGQRLL | (SEQ ID NO: 4548) |
| 18 | IQQTTLLLL | (SEQ ID NO: 4549) |
| 501 | AKMNFSYGL | (SEQ ID NO: 4550) |
| 498 | NEPAKMNFS | (SEQ ID NO: 4551) |
| 464 | SVGKRRCIG | (SEQ ID NO: 4552) |
| 446 | LDKDGLINK | (SEQ ID NO: 4553) |
| 412 | YHIPKDTVV | (SEQ ID NO: 4554) |
| 402 | ATTANTSVL | (SEQ ID NO: 4555) |
| 374 | DQPNLPYVL | (SEQ ID NO: 4556) |
| 370 | PCMGDQPNL | (SEQ ID NO: 4557) |
| 351 | DVQTRVQAE | (SEQ ID NO: 4558) |
| 335 | LSTALQWLL | (SEQ ID NO: 4559) |
| 307 | DSHGGGARL | (SEQ ID NO: 4560) |
| 300 | AEKKAAGDS | (SEQ ID NO: 4561) |
| 290 | RDMMDAFIL | (SEQ ID NO: 4562) |
| 280 | CESLRPGAA | (SEQ ID NO: 4563) |
| 275 | KFLRHCESL | (SEQ ID NO: 4564) |
| 274 | DKFLRHCES | (SEQ ID NO: 4565) |
| 273 | LDKFLRHCE | (SEQ ID NO: 4566) |
| 256 | TVFREFEQL | (SEQ ID NO: 4567) |
| 251 | PNPVRTVFR | (SEQ ID NO: 4568) |
| 220 | EFRELLSHN | (SEQ ID NO: 4569) |
| 183 | RGSADGAFL | (SEQ ID NO: 4570) |
| 158 | RQPRSRQVL | (SEQ ID NO: 4571) |
| 149 | HSMMRNFFT | (SEQ ID NO: 4572) |
| 147 | AAHSMMRNF | (SEQ ID NO: 4573) |
| 97 | LNGERAIHQ | (SEQ ID NO: 4574) |
| 31 | ATVHVGQRL | (SEQ ID NO: 4575) |
| 19 | QQTTLLLLL | (SEQ ID NO: 4576) |
| 16 | LSIQQTTLL | (SEQ ID NO: 4577) |
| 8 | NDPWPLNPL | (SEQ ID NO: 4578) |
| 5 | LSPNDPWPL | (SEQ ID NO: 4579) |
| 527 | ELLDSAVQN | (SEQ ID NO: 4580) |
| 380 | YVLAFLYEA | (SEQ ID NO: 4581) |
| 355 | RVQAELDQV | (SEQ ID NO: 4582) |
| 335 | LSTALQWLL | (SEQ ID NO: 4583) |
| 327 | IFGASQDTL | (SEQ ID NO: 4584) |
| 319 | NVPATLTDI | (SEQ ID NO: 4585) |

-continued

| | | |
|---|---|---|
| 310 | GGGARLDLE | (SEQ ID NO: 4586) |
| 302 | KKAAGDSHG | (SEQ ID NO: 4587) |
| 301 | EKKAAGDSH | (SEQ ID NO: 4588) |
| 297 | ILSAEKKAA | (SEQ ID NO: 4589) |
| 292 | MMDAFILSA | (SEQ ID NO: 4590) |
| 285 | PGAAPRDMM | (SEQ ID NO: 4591) |
| 284 | RPGAAPRDM | (SEQ ID NO: 4592) |
| 234 | TVGAGSLVD | (SEQ ID NO: 4593) |
| 204 | VMSAVCFGC | (SEQ ID NO: 4594) |
| 199 | VAVANVMSA | (SEQ ID NO: 4595) |
| 197 | TVVAVANVM | (SEQ ID NO: 4596) |
| 186 | ADGAFLDPR | (SEQ ID NO: 4597) |
| 183 | RGSADGAFL | (SEQ ID NO: 4598) |
| 176 | ELVALLVRG | (SEQ ID NO: 4599) |
| 171 | LSEARELVA | (SEQ ID NO: 4600) |
| 145 | RRAAHSMMR | (SEQ ID NO: 4601) |
| 144 | QRRAAHSMM | (SEQ ID NO: 4602) |
| 130 | RSMAFGHYS | (SEQ ID NO: 4603) |
| 118 | PAFASFRVV | (SEQ ID NO: 4604) |
| 116 | DRPAFASFR | (SEQ ID NO: 4605) |
| 112 | SAFADRPAF | (SEQ ID NO: 4606) |
| 110 | QGSAFADRP | (SEQ ID NO: 4607) |
| 103 | IHQALVQQG | (SEQ ID NO: 4608) |
| 99 | GERAIHQAL | (SEQ ID NO: 4609) |
| 75 | ARLARRYGD | (SEQ ID NO: 4610) |
| 72 | LSFARLARR | (SEQ ID NO: 4611) |
| 67 | GQAAHLSFA | (SEQ ID NO: 4612) |
| 66 | VGQAAHLSF | (SEQ ID NO: 4613) |
| 62 | NAAAVGQAA | (SEQ ID NO: 4614) |
| 61 | GNAAAVGQA | (SEQ ID NO: 4615) |
| 60 | IGNAAAVGQ | (SEQ ID NO: 4616) |
| 53 | GPFAWPLIG | (SEQ ID NO: 4617) |
| 47 | LRSAPPGPF | (SEQ ID NO: 4618) |
| 28 | SVLATVHVG | (SEQ ID NO: 4619) |
| 63 | AAAVGQAAHL | (SEQ ID NO: 4620) |
| 303 | KAAGDSHGGG | (SEQ ID NO: 4621) |
| 286 | GAAPRDMMDA | (SEQ ID NO: 4622) |
| 146 | RAAHSMMRNF | (SEQ ID NO: 4623) |
| 68 | QAAHLSFARL | (SEQ ID NO: 4624) |
| 62 | NAAAVGQAAH | (SEQ ID NO: 4625) |
| 200 | AVANVMSAVC | (SEQ ID NO: 4626) |
| 119 | AFASFRVVSG | (SEQ ID NO: 4627) |
| 113 | AFADRPAFAS | (SEQ ID NO: 4628) |
| 530 | DSAVQNLQAK | (SEQ ID NO: 4629) |
| 499 | EPAKMNFSYG | (SEQ ID NO: 4630) |
| 493 | FRANPNEPAK | (SEQ ID NO: 4631) |
| 504 | NFSYGLTIK | (SEQ ID NO: 4632) |
| 486 | ILAHQCDFR | (SEQ ID NO: 4633) |
| 445 | FLDKDGLIN | (SEQ ID NO: 4634) |
| 368 | RLPCMGDQP | (SEQ ID NO: 4635) |
| 363 | VVGRDRLPC | (SEQ ID NO: 4636) |
| 352 | VQTRVQAEL | (SEQ ID NO: 4637) |
| 314 | RLDLENVPA | (SEQ ID NO: 4638) |
| 309 | HGGGARLDL | (SEQ ID NO: 4639) |
| 295 | AFILSAEKK | (SEQ ID NO: 4640) |
| 285 | PGAAPRDMM | (SEQ ID NO: 4641) |
| 267 | NFSNFILDK | (SEQ ID NO: 4642) |
| 259 | REFEQLNRN | (SEQ ID NO: 4643) |
| 234 | TVGAGSLVD | (SEQ ID NO: 4644) |
| 207 | AVCFGCRYS | (SEQ ID NO: 4645) |
| 195 | PLTVVAVAN | (SEQ ID NO: 4646) |
| 192 | DPRPLTVVA | (SEQ ID NO: 4647) |
| 188 | GAFLDPRPL | (SEQ ID NO: 4648) |
| 187 | DGAFLDPRP | (SEQ ID NO: 4649) |
| 179 | ALLVRGSAD | (SEQ ID NO: 4650) |
| 170 | VLSEARELV | (SEQ ID NO: 4651) |
| 154 | NFFTRQPRS | (SEQ ID NO: 4652) |
| 148 | AHSMMRNFF | (SEQ ID NO: 4653) |
| 144 | QRRAAHSMM | (SEQ ID NO: 4654) |
| 132 | MAFGHYSEH | (SEQ ID NO: 4655) |
| 99 | GERAIHQAL | (SEQ ID NO: 4656) |
| 86 | QLRLGSCPI | (SEQ ID NO: 4657) |
| 81 | YGDVFQIRL | (SEQ ID NO: 4658) |
| 77 | LARRYGDVF | (SEQ ID NO: 4659) |
| 51 | PPGPFAWPL | (SEQ ID NO: 4660) |
| 47 | LRSAPPGPF | (SEQ ID NO: 4661) |
| 38 | RLLRQRRRQ | (SEQ ID NO: 4662) |
| 23 | LLLLLSVLA | (SEQ ID NO: 4663) |
| 9 | DPWPLNPLS | (SEQ ID NO: 4664) |
| 535 | NLQAKETCQ | (SEQ ID NO: 4665) |
| 530 | DSAVQNLQA | (SEQ ID NO: 4666) |
| 501 | AKMNFSYGL | (SEQ ID NO: 4667) |
| 467 | KRRCIGEEI | (SEQ ID NO: 4668) |
| 453 | NKDLTSRVM | (SEQ ID NO: 4669) |
| 439 | NFDPARFLD | (SEQ ID NO: 4670) |
| 389 | MRFSSFVPV | (SEQ ID NO: 4671) |
| 335 | LSTALQWLL | (SEQ ID NO: 4672) |
| 297 | ILSAEKKAA | (SEQ ID NO: 4673) |
| 276 | FLRHCESLR | (SEQ ID NO: 4674) |
| 274 | DKFLRHCES | (SEQ ID NO: 4675) |
| 265 | NRNFSNFIL | (SEQ ID NO: 4676) |
| 257 | VFREFEQLN | (SEQ ID NO: 4677) |
| 235 | VGAGSLVDV | (SEQ ID NO: 4678) |
| 232 | GRTVGAGSL | (SEQ ID NO: 4679) |
| 183 | RGSADGAFL | (SEQ ID NO: 4680) |
| 180 | LLVRGSADG | (SEQ ID NO: 4681) |
| 143 | VQRRAAHSM | (SEQ ID NO: 4682) |
| 119 | AFASFRVVS | (SEQ ID NO: 4683) |
| 113 | AFADRPAFA | (SEQ ID NO: 4684) |
| 88 | RLGSCPIVV | (SEQ ID NO: 4685) |
| 71 | HLSFARLAR | (SEQ ID NO: 4686) |
| 284 | RPGAAPRDM | (SEQ ID NO: 4687) |
| 253 | PVRTVFREF | (SEQ ID NO: 4688) |
| 213 | RYSHDDPEF | (SEQ ID NO: 4689) |
| 197 | TVVAVANVM | (SEQ ID NO: 4690) |
| 147 | AAHSMMRNF | (SEQ ID NO: 4691) |
| 124 | RVVSGGRSM | (SEQ ID NO: 4692) |
| 112 | SAFADRPAF | (SEQ ID NO: 4693) |
| 47 | LRSAPPGPF | (SEQ ID NO: 4694) |
| 508 | GLTIKPKSF | (SEQ ID NO: 4695) |
| 473 | EELSKMQLF | (SEQ ID NO: 4696) |
| 386 | YEAMRFSSF | (SEQ ID NO: 4697) |
| 383 | AFLYEAMRF | (SEQ ID NO: 4698) |
| 381 | VLAFLYEAM | (SEQ ID NO: 4699) |
| 364 | VGRDRLPCM | (SEQ ID NO: 4700) |
| 248 | QYFPNPVRT | (SEQ ID NO: 4701) |
| 242 | DVMPWLQYF | (SEQ ID NO: 4702) |
| 223 | ELLSHNEEF | (SEQ ID NO: 4703) |
| 202 | ANVMSAVCF | (SEQ ID NO: 4704) |
| 126 | VSGGRSMAF | (SEQ ID NO: 4705) |
| 115 | ADRPAFASF | (SEQ ID NO: 4706) |
| 106 | ALVQQGSAF | (SEQ ID NO: 4707) |
| 77 | LARRYGDVF | (SEQ ID NO: 4708) |
| 518 | VNVTLRESM | (SEQ ID NO: 4709) |
| 495 | ANPNEPAKM | (SEQ ID NO: 4710) |
| 470 | CIGEELSKM | (SEQ ID NO: 4711) |
| 455 | DLTSRVMIF | (SEQ ID NO: 4712) |
| 320 | VPATLTDLF | (SEQ ID NO: 4713) |
| 263 | QLNRNFSNF | (SEQ ID NO: 4714) |
| 182 | VRGSADGAF | (SEQ ID NO: 4715) |
| 485 | SLLAHCDF | (SEQ ID NO: 4716) |
| 475 | LSK-MQLFL | (SEQ ID NO: 4717) |
| 414 | IPKDTVVFV | (SEQ ID NO: 4718) |
| 349 | YPDVQTRVQ | (SEQ ID NO: 4719) |
| 338 | ALQWLLLLF | (SEQ ID NO: 4720) |
| 268 | FSNFILDKF | (SEQ ID NO: 4721) |
| 249 | YFPNPVRTV | (SEQ ID NO: 4722) |
| 192 | DPRPLTVVA | (SEQ ID NO: 4723) |
| 144 | QRRAAHSMM | (SEQ ID NO: 4724) |
| 143 | VQRRAAHSM | (SEQ ID NO: 4725) |
| 119 | AFASFRVVS | (SEQ ID NO: 4726) |
| 90 | GSCPIVVLN | (SEQ ID NO: 4727) |
| 66 | VGQAAHLSF | (SEQ ID NO: 4728) |
| 511 | IKPKSFKVN | (SEQ ID NO: 4729) |
| 494 | RANPNEPAK | (SEQ ID NO: 4730) |
| 452 | INKDLTSRV | (SEQ ID NO: 4731) |
| 391 | FSSFVPVTI | (SEQ ID NO: 4732) |
| 390 | RFSSFVPVT | (SEQ ID NO: 4733) |
| 373 | GDQPNLPYV | (SEQ ID NO: 4734) |
| 359 | ELDQVVGRD | (SEQ ID NO: 4735) |
| 357 | QAELDQVVG | (SEQ ID NO: 4736) |
| 347 | TRYPDVQTR | (SEQ ID NO: 4737) |
| 315 | LDLENVPAT | (SEQ ID NO: 4738) |
| 297 | ILSAEKKAA | (SEQ ID NO: 4739) |
| 272 | ILDKFLRHC | (SEQ ID NO: 4740) |
| 228 | NEEFGRTVG | (SEQ ID NO: 4741) |
| 519 | NVTLRESME | (SEQ ID NO: 4742) |
| 499 | EPAKMNFSY | (SEQ ID NO: 4743) |

-continued

| | | |
|---|---|---|
| 496 | NPNEPAKMN | (SEQ ID NO: 4744) |
| 481 | FLFLSLLAH | (SEQ ID NO: 4745) |
| 466 | GKRRCIGEE | (SEQ ID NO: 4746) |
| 440 | FDPARFLDK | (SEQ ID NO: 4747) |
| 409 | VLGYHIPKD | (SEQ ID NO: 4748) |
| 384 | FLYEAMRFS | (SEQ ID NO: 4749) |
| 359 | ELDQVVGRD | (SEQ ID NO: 4750) |
| 346 | FTRYPDVQT | (SEQ ID NO: 4751) |
| 314 | RLDLENVPA | (SEQ ID NO: 4752) |
| 310 | GGGARLDLE | (SEQ ID NO: 4753) |
| 297 | ILSAEKKAA | (SEQ ID NO: 4754) |
| 260 | EFEQLNRNF | (SEQ ID NO: 4755) |
| 257 | VFREFEQLN | (SEQ ID NO: 4756) |
| 255 | RTVFREFEQ | (SEQ ID NO: 4757) |
| 195 | PLTVVAVAN | (SEQ ID NO: 4758) |
| 176 | ELVALLVRG | (SEQ ID NO: 4759) |
| 170 | VLSEARELV | (SEQ ID NO: 4760) |
| 141 | WKVQRRAAH | (SEQ ID NO: 4761) |
| 122 | SFRVVSGGR | (SEQ ID NO: 4762) |
| 84 | VFQIRLGSC | (SEQ ID NO: 4763) |
| 44 | RRQLRSAPP | (SEQ ID NO: 4764) |
| 37 | QRLLRQRRR | (SEQ ID NO: 4765) |
| 34 | HVGQRLLRQ | (SEQ ID NO: 4766) |
| 24 | LLLLSVLAT | (SEQ ID NO: 4767) |
| 490 | QCDFRANPN | (SEQ ID NO: 4768) |
| 476 | SKMQLFLFI | (SEQ ID NO: 4769) |
| 457 | TSRVMIFSV | (SEQ ID NO: 4770) |
| 395 | VPVTIPHAT | (SEQ ID NO: 4771) |
| 391 | FSSFVPVTI | (SEQ ID NO: 4772) |
| 381 | VLAFLYEAM | (SEQ ID NO: 4773) |
| 376 | PNLPYVLAF | (SEQ ID NO: 4774) |
| 375 | QPNLPYVLA | (SEQ ID NO: 4775) |
| 362 | QVVGRDRLP | (SEQ ID NO: 4776) |
| 211 | GCRYSHDDP | (SEQ ID NO: 4777) |
| 209 | CFGCRYSHD | (SEQ ID NO: 4778) |
| 182 | VRGSADGAF | (SEQ ID NO: 4779) |
| 171 | LSEARELVA | (SEQ ID NO: 4780) |
| 165 | VLEGHVLSE | (SEQ ID NO: 4781) |
| 157 | TRQPRSRQV | (SEQ ID NO: 4782) |
| 154 | NFFTRQPRS | (SEQ ID NO: 4783) |
| 142 | KVQRRAAHS | (SEQ ID NO: 4784) |
| 113 | AFADRPAFA | (SEQ ID NO: 4785) |
| 95 | VVLNGERAI | (SEQ ID NO: 4786) |
| 78 | ARRYGDVFQ | (SEQ ID NO: 4787) |
| 75 | ARLARRYGD | (SEQ ID NO: 4788) |
| 72 | LSFARLARR | (SEQ ID NO: 4789) |
| 71 | HLSFARLAR | (SEQ ID NO: 4790) |
| 57 | WPLIGNAAA | (SEQ ID NO: 4791) |
| 40 | LRQRRRQLR | (SEQ ID NO: 4792) |
| 36 | GQRLLRQRR | (SEQ ID NO: 4793) |
| 29 | VLATVHVGQ | (SEQ ID NO: 4794) |
| 23 | LLLLLSVLA | (SEQ ID NO: 4795) |
| 6 | SPNDPWPLN | (SEQ ID NO: 4796) |
| 486 | ILAHQCDFRA | (SEQ ID NO: 4797) |
| 441 | DPARFLDKDG | (SEQ ID NO: 4798) |
| 403 | TTANTSVLGY | (SEQ ID NO: 4799) |
| 400 | PHATTANTSV | (SEQ ID NO: 4800) |
| 386 | YEAMRFSSFV | (SEQ ID NO: 4801) |
| 381 | VLAFLYEAMR | (SEQ ID NO: 4802) |
| 356 | VQAELDQVVG | (SEQ ID NO: 4803) |
| 336 | STALQWLLLL | (SEQ ID NO: 4804) |
| 328 | FGASQDTLST | (SEQ ID NO: 4805) |
| 320 | VPATLTDLFG | (SEQ ID NO: 4806) |
| 311 | GGARLDLENV | (SEQ ID NO: 4807) |
| 304 | AAGDSHGGGA | (SEQ ID NO: 4808) |
| 302 | KKAAGDSHGG | (SEQ ID NO: 4809) |
| 298 | LSAEKKAAGD | (SEQ ID NO: 4810) |
| 293 | MDAFILSAEK | (SEQ ID NO: 4811) |
| 287 | AAPRDMMDAF | (SEQ ID NO: 4812) |
| 285 | PGAAPRDMMD | (SEQ ID NO: 4813) |
| 235 | VGAGSLVDVM | (SEQ ID NO: 4814) |
| 205 | MSAVCFGCRY | (SEQ ID NO: 4815) |
| 198 | VVAVANVMSA | (SEQ ID NO: 4816) |
| 187 | DGAFLDPRPL | (SEQ ID NO: 4817) |
| 184 | GSADGAFLDP | (SEQ ID NO: 4818) |
| 177 | LVALLVRGSA | (SEQ ID NO: 4819) |
| 172 | SEARELVALL | (SEQ ID NO: 4820) |
| 147 | AAHSMMRNFF | (SEQ ID NO: 4821) |
| 145 | RRAAHSMMRN | (SEQ ID NO: 4822) |
| 131 | SMAFGHYSEH | (SEQ ID NO: 4823) |
| 117 | RPAFASFRVV | (SEQ ID NO: 4824) |
| 111 | LGSAFADRPAF | (SEQ ID NO: 4825) |
| 104 | HQALVQQGSA | (SEQ ID NO: 4826) |
| 100 | ERAIHQALVQ | (SEQ ID NO: 4827) |
| 76 | RLARRYGDVF | (SEQ ID NO: 4828) |
| 73 | SFARLARRYG | (SEQ ID NO: 4829) |
| 69 | AAHLSFARLA | (SEQ ID NO: 4830) |
| 67 | GQAAHLSFAR | (SEQ ID NO: 4831) |
| 64 | AAVGQAAHLS | (SEQ ID NO: 4832) |
| 61 | GNAAAVGQAA | (SEQ ID NO: 4833) |
| 54 | PFAWPLIGNA | (SEQ ID NO: 4834) |
| 48 | RSAPPGPFAW | (SEQ ID NO: 4835) |
| 29 | VLATVHVGQR | (SEQ ID NO: 4836) |
| 531 | SAVQNLQAKE | (SEQ ID NO: 4837) |
| 500 | PAKMNFSYGL | (SEQ ID NO: 4838) |
| 494 | RANPNEPAKM | (SEQ ID NO: 4839) |
| 487 | LAHQCDFRAN | (SEQ ID NO: 4840) |
| 442 | PARFLDKDGL | (SEQ ID NO: 4841) |
| 404 | TANTSVLGYH | (SEQ ID NO: 4842) |
| 401 | HATTANTSVL | (SEQ ID NO: 4843) |
| 387 | EAMRFSSFVP | (SEQ ID NO: 4844) |
| 382 | LAFLYEAMRF | (SEQ ID NO: 4845) |
| 357 | QAELDQVVGR | (SEQ ID NO: 4846) |
| 337 | TALQWLLLLF | (SEQ ID NO: 4847) |
| 329 | GASQDTLSTA | (SEQ ID NO: 4848) |
| 321 | PATLTDLFGA | (SEQ ID NO: 4849) |
| 312 | GARLDLENVP | (SEQ ID NO: 4850) |
| 299 | SAEKKAAGDS | (SEQ ID NO: 4851) |
| 294 | DAFILSAEKK | (SEQ ID NO: 4852) |
| 26 | LLSVLATVH | (SEQ ID NO: 4853) |
| 5 | LSPNDPWPL | (SEQ ID NO: 4854) |
| 460 | VMIFSVGKR | (SEQ ID NO: 4855) |
| 448 | KDGLINKDL | (SEQ ID NO: 4856) |
| 444 | RFLDKDGLI | (SEQ ID NO: 4857) |
| 424 | QWSVNHDPL | (SEQ ID NO: 4858) |
| 420 | VFVNQWSVN | (SEQ ID NO: 4859) |
| 393 | SFVPVTIPH | (SEQ ID NO: 4860) |
| 358 | AELDQVVGR | (SEQ ID NO: 4861) |
| 343 | LLLFTRYPD | (SEQ ID NO: 4862) |
| 342 | LLLLFTRYP | (SEQ ID NO: 4863) |
| 318 | ENVPATITD | (SEQ ID NO: 4864) |
| 315 | LDLENVPAT | (SEQ ID NO: 4865) |
| 301 | EKKAAGDSH | (SEQ ID NO: 4866) |
| 290 | RDMMDAFIL | (SEQ ID NO: 4867) |
| 284 | RPGAAPRDM | (SEQ ID NO: 4868) |
| 281 | ESLRPGAAP | (SEQ ID NO: 4869) |
| 270 | NFILDKFLR | (SEQ ID NO: 4870) |
| 246 | WLQYFPNPN | (SEQ ID NO: 4871) |
| 224 | LLSHNEEFG | (SEQ ID NO: 4872) |
| 189 | AFLDPRPLT | (SEQ ID NO: 4873) |
| 167 | EGHVLSEA3 | (SEQ ID NO: 4874) |
| 163 | RQVLEGHVL | (SEQ ID NO: 4875) |
| 155 | FFTRQPRSR | (SEQ ID NO: 4876) |
| 146 | RAAHSMMRN | (SEQ ID NO: 4877) |
| 139 | EHWKVQRRA | (SEQ ID NO: 4878) |
| 121 | ASFRVVSGG | (SEQ ID NO: 4879) |
| 116 | DRPAFASFR | (SEQ ID NO: 4880) |
| 100 | ERAIHQALV | (SEQ ID NO: 4881) |
| 72 | LSFARLARR | (SEQ ID NO: 4882) |
| 55 | FAWPLIGNA | (SEQ ID NO: 4883) |
| 50 | APPGPFAWP | (SEQ ID NO: 4884) |
| 13 | LNPLSIQQT | (SEQ ID NO: 4885) |
| 531 | SAVQNLQAK | (SEQ ID NO: 4886) |
| 511 | IKPKSFKVN | (SEQ ID NO: 4887) |
| 462 | IFSVGKRRC | (SEQ ID NO: 4888) |
| 446 | LDKDGLINK | (SEQ ID NO: 4889) |
| 435 | PNPENFDPA | (SEQ ID NO: 4890) |
| 430 | DPLKWPNPE | (SEQ ID NO: 4891) |
| 414 | IPKDTVVFV | (SEQ ID NO: 4892) |
| 387 | EAMRFSSFV | (SEQ ID NO: 4893) |
| 373 | GDQPNLPYV | (SEQ ID NO: 4894) |
| 347 | TRYPDVQTR | (SEQ ID NO: 4895) |
| 293 | MDAFILSAE | (SEQ ID NO: 4896) |
| 278 | RHCESLRPG | (SEQ ID NO: 4897) |
| 266 | RNFSNFILO | (SEQ ID NO: 4898) |
| 262 | EQLNRNFSN | (SEQ ID NO: 4899) |
| 245 | PWLQYFPNP | (SEQ ID NO: 4900) |
| 226 | SHNEEFGRT | (SEQ ID NO: 4901) |

-continued

| | | |
|---|---|---|
| 219 | PEFRELLSH | (SEQ ID NO: 4902) |
| 193 | PRPLTVVAV | (SEQ ID NO: 4903) |
| 185 | SADGAFLDP | (SEQ ID NO: 4904) |
| 138 | SEHWKVQRR | (SEQ ID NO: 4905) |
| 133 | AFGHYSEHW | (SEQ ID NO: 4906) |
| 122 | SFRVVSGGR | (SEQ ID NO: 4907) |
| 118 | PAFASFRVV | (SEQ ID NO: 4908) |
| 227 | HNEEFGRTV | (SEQ ID NO: 4909) |
| 176 | ELVALLVRG | (SEQ ID NO: 4910) |
| 157 | TRQPRSRQV | (SEQ ID NO: 4911) |
| 156 | FTRQPRSRQ | (SEQ ID NO: 4912) |
| 140 | HWKVQRRAA | (SEQ ID NO: 4913) |
| 137 | YSEHWKVQR | (SEQ ID NO: 4914) |
| 94 | IVVLNGERA | (SEQ ID NO: 4915) |
| 73 | SFARLARRY | (SEQ ID NO: 4916) |
| 49 | SAPPGPFAW | (SEQ ID NO: 4917) |
| 48 | RSAPPGPFA | (SEQ ID NO: 4918) |
| 38 | RLLRQRRRQ | (SEQ ID NO: 4919) |
| 4 | SLSPNDPWP | (SEQ ID NO: 4920) |
| 527 | ELLDSAVQN | (SEQ ID NO: 4921) |
| 517 | KVNVTLRES | (SEQ ID NO: 4922) |
| 513 | PKSFKVNVT | (SEQ ID NO: 4923) |
| 471 | IGEELSKMQ | (SEQ ID NO: 4924) |
| 463 | FSVGKRRCI | (SEQ ID NO: 4925) |
| 411 | GYHIPKDTV | (SEQ ID NO: 4926) |
| 403 | TTANTSVLG | (SEQ ID NO: 4927) |
| 384 | FLYEAMRFS | (SEQ ID NO: 4928) |
| 358 | AELDQVVGR | (SEQ ID NO: 4929) |
| 356 | VQAELDQVV | (SEQ ID NO: 4930) |
| 350 | PDVQTRVQA | (SEQ ID NO: 4931) |
| 318 | ENVPATITD | (SEQ ID NO: 4932) |
| 306 | GDSHGGGAR | (SEQ ID NO: 4933) |
| 298 | LSAEKKAAG | (SEQ ID NO: 4934) |
| 286 | GAAPRDMMD | (SEQ ID NO: 4935) |
| 283 | LRPGAAPRD | (SEQ ID NO: 4936) |
| 247 | LQYFPNPVR | (SEQ ID NO: 4937) |
| 235 | VGAGSLVDV | (SEQ ID NO: 4938) |
| 234 | TVGAGSLVD | (SEQ ID NO: 4939) |
| 229 | EEFGRTVGA | (SEQ ID NO: 4940) |
| 198 | VVAVANVMS | (SEQ ID NO: 4941) |
| 195 | PLTVVAVAN | (SEQ ID NO: 4942) |
| 193 | PRPLTVVAV | (SEQ ID NO: 4943) |
| 190 | FLDPRPLTV | (SEQ ID NO: 4944) |
| 189 | AFLDPRPLT | (SEQ ID NO: 4945) |
| 187 | DGAFLDPRP | (SEQ ID NO: 4946) |
| 184 | GSADGAFLD | (SEQ ID NO: 4947) |
| 177 | LVALLVRGS | (SEQ ID NO: 4948) |
| 164 | QVLEGHVLS | (SEQ ID NO: 4949) |
| 146 | RAAHSMMRN | (SEQ ID NO: 4950) |
| 136 | HYSEHWKVQ | (SEQ ID NO: 4951) |
| 125 | VVSGGRSMA | (SEQ ID NO: 4952) |
| 120 | FASFRVVSG | (SEQ ID NO: 4953) |
| 118 | PAFASFRVV | (SEQ ID NO: 4954) |
| 111 | GSAFADRPA | (SEQ ID NO: 4955) |
| 95 | VVLNGERAI | (SEQ ID NO: 4956) |
| 87 | IRLGSCPIV | (SEQ ID NO: 4957) |
| 82 | GDVFQIRLG | (SEQ ID NO: 4958) |
| 63 | AAAVGQAAH | (SEQ ID NO: 4959) |
| 60 | IGNAAAVGQ | (SEQ ID NO: 4960) |
| 37 | QRLLRQRRR | (SEQ ID NO: 4961) |
| 36 | GQRLLRQRR | (SEQ ID NO: 4962) |
| 26 | LLSVLATVH | (SEQ ID NO: 4963) |
| 534 | QNLQAKETC | (SEQ ID NO: 4964) |
| 4 | SLSPNDPWP | (SEQ ID NO: 4965) |
| 531 | SAVQNLQAK | (SEQ ID NO: 4966) |
| 492 | DFRANPNEP | (SEQ ID NO: 4967) |
| 486 | ILAHCDFR | (SEQ ID NO: 4968) |
| 454 | KDLTSRVMI | (SEQ ID NO: 4969) |
| 445 | FLDKDGLIN | (SEQ ID NO: 4970) |
| 436 | NPENFDPAR | (SEQ ID NO: 4971) |
| 434 | WPNPENFDP | (SEQ ID NO: 4972) |
| 406 | NTSVLGYHI | (SEQ ID NO: 4973) |
| 399 | IPHATTANT | (SEQ ID NO: 4974) |
| 383 | AFLYEAMRF | (SEQ ID NO: 4975) |
| 378 | LPYVLAFLY | (SEQ ID NO: 4976) |
| 366 | RDRLPCMGD | (SEQ ID NO: 4977) |
| 353 | QTRVQAELD | (SEQ ID NO: 4978) |
| 349 | YPDVQTRVQ | (SEQ ID NO: 4979) |
| 342 | LLLLFTRYP | (SEQ ID NO: 4980) |
| 341 | WLLLLFTRY | (SEQ ID NO: 4981) |
| 319 | NVPATITDI | (SEQ ID NO: 4982) |
| 272 | ILDKFLRHC | (SEQ ID NO: 4983) |
| 268 | FSNFILDKF | (SEQ ID NO: 4984) |
| 252 | NPVRTVFRE | (SEQ ID NO: 4985) |
| 246 | WLQYFPNPV | (SEQ ID NO: 4986) |
| 244 | MPWLQYFPN | (SEQ ID NO: 4987) |
| 231 | FGRTVGAGS | (SEQ ID NO: 4988) |
| 213 | RYSHDDPEF | (SEQ ID NO: 4989) |
| 202 | ANVMSAVCF | (SEQ ID NO: 4990) |
| 194 | RPLTVVAVA | (SEQ ID NO: 4991) |
| 156 | FTRQPRSRQ | (SEQ ID NO: 4992) |
| 143 | VQRRAAHSM | (SEQ ID NO: 4993) |
| 128 | GGRSMAFGH | (SEQ ID NO: 4994) |
| 96 | VLNGERAIH | (SEQ ID NO: 4995) |
| 93 | PIVVLNGER | (SEQ ID NO: 4996) |
| 92 | CPIVVLNGE | (SEQ ID NO: 4997) |
| 79 | RRYGDVFQI | (SEQ ID NO: 4998) |
| 66 | VGQAAHLSF | (SEQ ID NO: 4999) |
| 58 | PLIGNAAAV | (SEQ ID NO: 5000) |
| 53 | GPFAWPLIG | (SEQ ID NO: 5001) |
| 49 | SAPPGPFAW | (SEQ ID NO: 5002) |
| 43 | RRRQLRSAP | (SEQ ID NO: 5003) |
| 26 | LLSVLATVH | (SEQ ID NO: 5004) |
| 10 | PWPLNPLSI | (SEQ ID NO: 5005) |
| 9 | DPWPLNPLS | (SEQ ID NO: 5006) |
| 503 | MNFSYGLTI | (SEQ ID NO: 5007) |
| 497 | PNEPAKMNF | (SEQ ID NO: 5008) |
| 478 | MQLFLFLSI | (SEQ ID NO: 5009) |
| 470 | CIGEELSKM | (SEQ ID NO: 5010) |
| 441 | DPARFLDKD | (SEQ ID NO: 5011) |
| 437 | PENFDPARF | (SEQ ID NO: 5012) |
| 432 | LKWPNPENF | (SEQ ID NO: 5013) |
| 430 | DPLKWPNPE | (SEQ ID NO: 5014) |
| 401 | HATTANTSV | (SEQ ID NO: 5015) |
| 388 | AMRFSSFVP | (SEQ ID NO: 5016) |
| 387 | EAMRFSSFV | (SEQ ID NO: 5017) |
| 369 | LPCMGDQPN | (SEQ ID NO: 5018) |
| 368 | RLPCMGDQP | (SEQ ID NO: 5019) |
| 357 | QAELDQVVG | (SEQ ID NO: 5020) |
| 236 | GAGSLWDVMP | (SEQ ID NO: 5021) |
| 206 | SAVCFGCRYS | (SEQ ID NO: 5022) |
| 201 | VANVMSAVCF | (SEQ ID NO: 5023) |
| 199 | VAVANVMSAV | (SEQ ID NO: 5024) |
| 188 | GAFLDPRPLT | (SEQ ID NO: 5025) |
| 185 | SADGAFLDPR | (SEQ ID NO: 5026) |
| 178 | VALLVRGSAD | (SEQ ID NO: 5027) |
| 173 | EARELVALLV | (SEQ ID NO: 5028) |
| 132 | MAFGHYSEHW | (SEQ ID NO: 5029) |
| 120 | FASFRVVSGG | (SEQ ID NO: 5030) |
| 118 | PAFASFRVVS | (SEQ ID NO: 5031) |
| 114 | FADRPAFASF | (SEQ ID NO: 5032) |
| 112 | SAFADRPAFA | (SEQ ID NO: 5033) |
| 105 | QALVQQGSAF | (SEQ ID NO: 5034) |
| 101 | RAIHQALVQQ | (SEQ ID NO: 5035) |
| 77 | LARRYGDVFQ | (SEQ ID NO: 5036) |
| 74 | FARLARRYGD | (SEQ ID NO: 5037) |
| 55 | FAWPLIGNAA | (SEQ ID NO: 5038) |
| 49 | SAPPGPFAWP | (SEQ ID NO: 5039) |
| 30 | LATVHGQRL | (SEQ ID NO: 5040) |
| 532 | AVQNLQAKET | (SEQ ID NO: 5041) |
| 501 | AKMNFSYGLT | (SEQ ID NO: 5042) |
| 495 | ANPNEPAKMN | (SEQ ID NO: 5043) |
| 488 | AHQCDFRANP | (SEQ ID NO: 5044) |
| 443 | ARFLDKDGLI | (SEQ ID NO: 5045) |
| 405 | ANTSVLGYHI | (SEQ ID NO: 5046) |
| 402 | ATTANTSVLG | (SEQ ID NO: 5047) |
| 388 | AMRFSSFVPV | (SEQ ID NO: 5048) |
| 383 | AFLYEAMRFS | (SEQ ID NO: 5049) |
| 358 | AELDQVVGRD | (SEQ ID NO: 5050) |
| 338 | ALQWLLLLFT | (SEQ ID NO: 5051) |
| 330 | ASQDTLSTAL | (SEQ ID NO: 5052) |
| 322 | ATLTDLFGAS | (SEQ ID NO: 5053) |
| 313 | ARLDLENVPA | (SEQ ID NO: 5054) |
| 305 | AGDSHGGGAR | (SEQ ID NO: 5055) |
| 300 | AEKKAAGDSH | (SEQ ID NO: 5056) |
| 295 | AFILSAEKKA | (SEQ ID NO: 5057) |
| 288 | APRDMMDAFI | (SEQ ID NO: 5058) |
| 237 | AGSLVDVMPW | (SEQ ID NO: 5059) |

-continued

| | | |
|---|---|---|
| 207 | AVCFGCRYSH | (SEQ ID NO: 5060) |
| 202 | ANVMSAVCFG | (SEQ ID NO: 5061) |
| 189 | AFLDPRPLTV | (SEQ ID NO: 5062) |
| 186 | ADGAFLDPRP | (SEQ ID NO: 5063) |
| 179 | ALLVRGSADG | (SEQ ID NO: 5064) |
| 174 | ARELVALLVR | (SEQ ID NO: 5065) |
| 148 | AHSMMRNFFT | (SEQ ID NO: 5066) |
| 133 | AFGHYSEHWK | (SEQ ID NO: 5067) |
| 121 | ASFRVVSGGR | (SEQ ID NO: 5068) |
| 115 | ADRPAFASFR | (SEQ ID NO: 5069) |
| 106 | ALVQQGSAFA | (SEQ ID NO: 5070) |
| 102 | AIHQALVQQG | (SEQ ID NO: 5071) |
| 78 | ARRYGDVFQI | (SEQ ID NO: 5072) |
| 75 | ARLARRYGDV | (SEQ ID NO: 5073) |
| 70 | AHLSFARLAR | (SEQ ID NO: 5074) |
| 65 | AVGQAAHLSF | (SEQ ID NO: 5075) |
| 56 | AWPLIGNAAA | (SEQ ID NO: 5076) |
| 50 | APPGPFAWPL | (SEQ ID NO: 5077) |
| 31 | ATVHVGQRLL | (SEQ ID NO: 5078) |
| 103 | IHQALVQQG | (SEQ ID NO: 5079) |
| 92 | CPIVVLNGE | (SEQ ID NO: 5080) |
| 90 | GSCPIVVLN | (SEQ ID NO: 5081) |
| 79 | RRYGDVFQI | (SEQ ID NO: 5082) |
| 500 | PAKMNFSYG | (SEQ ID NO: 5083) |
| 498 | NEPAKMNFS | (SEQ ID NO: 5084) |
| 480 | LFLFLSLLA | (SEQ ID NO: 5085) |
| 478 | MQLFLFLSI | (SEQ ID NO: 5086) |
| 476 | SKMQLFLFI | (SEQ ID NO: 5087) |
| 449 | DGLINKDLT | (SEQ ID NO: 5088) |
| 422 | VNQWSVNHD | (SEQ ID NO: 5089) |
| 416 | KDTVVFVNQ | (SEQ ID NO: 5090) |
| 392 | SSFVPVTIP | (SEQ ID NO: 5091) |
| 345 | LFTRYPDVQ | (SEQ ID NO: 5092) |
| 330 | ASQDTLSTA | (SEQ ID NO: 5093) |
| 298 | LSAEKKAAG | (SEQ ID NO: 5094) |
| 292 | MMDAFILSA | (SEQ ID NO: 5095) |
| 287 | AAPRDMMDA | (SEQ ID NO: 5096) |
| 248 | QYFPNPVRT | (SEQ ID NO: 5097) |
| 218 | DPEFRELLS | (SEQ ID NO: 5098) |
| 199 | VAVANVMSA | (SEQ ID NO: 5099) |
| 166 | LEGHVLSEA | (SEQ ID NO: 5100) |
| 161 | RSRQVLEGH | (SEQ ID NO: 5101) |
| 160 | PRSRQVLEG | (SEQ ID NO: 5102) |
| 127 | SGGRSMAFG | (SEQ ID NO: 5103) |
| 120 | FASFRVVSG | (SEQ ID NO: 5104) |
| 109 | QQGSAFADR | (SEQ ID NO: 5105) |
| 91 | SCPIVVLNG | (SEQ ID NO: 5106) |
| 80 | RYGDVFQIR | (SEQ ID NO: 5107) |
| 67 | GQAAHLSFA | (SEQ ID NO: 5108) |
| 61 | GNAAAVGQA | (SEQ ID NO: 5109) |
| 42 | QRRRQLRSA | (SEQ ID NO: 5110) |
| 35 | VGQRLLRQR | (SEQ ID NO: 5111) |
| 513 | PKSFKVNVT | (SEQ ID NO: 5112) |
| 502 | KMNFSYGLT | (SEQ ID NO: 5113) |
| 488 | AHQCDFRAN | (SEQ ID NO: 5114) |
| 469 | RCIGEELSK | (SEQ ID NO: 5115) |
| 466 | GKRRCIGEE | (SEQ ID NO: 5116) |
| 458 | SRVMIFSVG | (SEQ ID NO: 5117) |
| 457 | TSRVMIFSV | (SEQ ID NO: 5118) |
| 452 | INKDLTSRV | (SEQ ID NO: 5119) |
| 440 | FDPARFLDK | (SEQ ID NO: 5120) |
| 427 | VNHDPLKWP | (SEQ ID NO: 5121) |
| 415 | PKDTVVFVN | (SEQ ID NO: 5122) |
| 412 | YHIPKDTVV | (SEQ ID NO: 5123) |
| 405 | ANTSVLGYH | (SEQ ID NO: 5124) |
| 375 | QPNLPYVLA | (SEQ ID NO: 5125) |
| 356 | VQAELDQVV | (SEQ ID NO: 5126) |
| 340 | QWLLLLFTR | (SEQ ID NO: 5127) |
| 339 | LQWLLLLFT | (SEQ ID NO: 5128) |
| 312 | GARLDLENV | (SEQ ID NO: 5129) |
| 286 | GAAPRDMMD | (SEQ ID NO: 5130) |
| 283 | LRPGAAPRD | (SEQ ID NO: 5131) |
| 252 | NPVRTVFRE | (SEQ ID NO: 5132) |
| 244 | MPWLQYFPN | (SEQ ID NO: 5133) |
| 238 | GSLVDVMPW | (SEQ ID NO: 5134) |
| 208 | VCFGCRYSH | (SEQ ID NO: 5135) |
| 205 | MSAVCFGCR | (SEQ ID NO: 5136) |
| 531 | SAVQNLQAK | (SEQ ID NO: 5137) |
| 515 | SFKVNVTLR | (SEQ ID NO: 5138) |
| 512 | KPKSFKVNV | (SEQ ID NO: 5139) |
| 510 | TIKPKSFKV | (SEQ ID NO: 5140) |
| 509 | LTIKPKSFK | (SEQ ID NO: 5141) |
| 507 | YGLTIKPKS | (SEQ ID NO: 5142) |
| 499 | EPAKMNFSY | (SEQ ID NO: 5143) |
| 492 | DFRANPNEP | (SEQ ID NO: 5144) |
| 487 | LAHQCDFRA | (SEQ ID NO: 5145) |
| 486 | ILAHQCDFR | (SEQ ID NO: 5146) |
| 466 | GKRRCIGEE | (SEQ ID NO: 5147) |
| 457 | TSRVMIFSV | (SEQ ID NO: 5148) |
| 454 | KDLTSRVMI | (SEQ ID NO: 5149) |
| 439 | NFDPARFLD | (SEQ ID NO: 5150) |
| 436 | NPENFDPAR | (SEQ ID NO: 5151) |
| 431 | PLKWPNPEN | (SEQ ID NO: 5152) |
| 421 | FVNQWSVNH | (SEQ ID NO: 5153) |
| 416 | KDTVVFVNQ | (SEQ ID NO: 5154) |
| 415 | PKDTVVFVN | (SEQ ID NO: 5155) |
| 397 | VTIPHATTA | (SEQ ID NO: 5156) |
| 394 | FVPVTIPHA | (SEQ ID NO: 5157) |
| 392 | SSFVPVTIP | (SEQ ID NO: 5158) |
| 375 | QPNLPYVLA | (SEQ ID NO: 5159) |
| 367 | DRLPCMGDQ | (SEQ ID NO: 5160) |
| 362 | QVVGRDRLP | (SEQ ID NO: 5161) |
| 360 | LDQVVGRDR | (SEQ ID NO: 5162) |
| 348 | RYPDVQTRV | (SEQ ID NO: 5163) |
| 346 | FTRYPDVQT | (SEQ ID NO: 5164) |
| 345 | LFTRYPDVQ | (SEQ ID NO: 5165) |
| 329 | GASQDTLST | (SEQ ID NO: 5166) |
| 323 | TLTDLFGAS | (SEQ ID NO: 5167) |
| 316 | DLENVPATI | (SEQ ID NO: 5168) |
| 313 | ARLDLENVP | (SEQ ID NO: 5169) |
| 311 | GGARLDL-EN | (SEQ ID NO: 5170) |
| 282 | SLRPGAAPR | (SEQ ID NO: 5171) |
| 281 | ESLRPGAAP | (SEQ ID NO: 5172) |
| 280 | CESLRPGAA | (SEQ ID NO: 5173) |
| 279 | HCESLRPGA | (SEQ ID NO: 5174) |
| 271 | FILDKFLRH | (SEQ ID NO: 5175) |
| 259 | REFEQLNRN | (SEQ ID NO: 5176) |
| 252 | NPVRTVFRE | (SEQ ID NO: 5177) |
| 251 | PNPVRTVFR | (SEQ ID NO: 5178) |
| 238 | GSLVDVMPW | (SEQ ID NO: 5179) |
| 237 | AGSLVDVMP | (SEQ ID NO: 5180) |
| 230 | EFGRTVGAG | (SEQ ID NO: 5181) |
| 214 | YSHDDPEFR | (SEQ ID NO: 5182) |
| 207 | AVCFGCRYS | (SEQ ID NO: 5183) |
| 201 | VANVMSAVC | (SEQ ID NO: 5184) |
| 200 | AVANVMSAV | (SEQ ID NO: 5185) |
| 194 | RPLTVVAVA | (SEQ ID NO: 5186) |
| 191 | LDPRPLTVV | (SEQ ID NO: 5187) |
| 175 | RELVALLVR | (SEQ ID NO: 5188) |
| 171 | LSEARELVA | (SEQ ID NO: 5189) |
| 170 | VLSEARELV | (SEQ ID NO: 5190) |
| 167 | EGHVLSEAR | (SEQ ID NO: 5191) |
| 165 | VLEGHVLSE | (SEQ ID NO: 5192) |
| 160 | PRSRQVLEG | (SEQ ID NO: 5193) |
| 155 | FFTRQPRSR | (SEQ ID NO: 5194) |
| 343 | LLLFTRYPD | (SEQ ID NO: 5195) |
| 296 | FILSAEKKA | (SEQ ID NO: 5196) |
| 289 | PRDMMDAFI | (SEQ ID NO: 5197) |
| 284 | RPGAAPRDM | (SEQ ID NO: 5198) |
| 242 | DVMPWLQYF | (SEQ ID NO: 5199) |
| 236 | GAGSLVDVM | (SEQ ID NO: 5200) |
| 224 | LLSHNEEFG | (SEQ ID NO: 5201) |
| 206 | SAVCFGCRY | (SEQ ID NO: 5202) |
| 201 | VANVMSAVC | (SEQ ID NO: 5203) |
| 199 | VAVANVMSA | (SEQ ID NO: 5204) |
| 185 | SADGAFLDP | (SEQ ID NO: 5205) |
| 181 | LVRGSADGA | (SEQ ID NO: 5206) |
| 180 | LLVRGSADG | (SEQ ID NO: 5207) |
| 178 | VALLVRGSA | (SEQ ID NO: 5208) |
| 161 | RSRQVLEGH | (SEQ ID NO: 5209) |
| 151 | MMRNFFTRQ | (SEQ ID NO: 5210) |
| 148 | AHSMMRNFF | (SEQ ID NO: 5211) |
| 144 | QRRAAHSMM | (SEQ ID NO: 5212) |
| 117 | RPAFASFRV | (SEQ ID NO: 5213) |
| 114 | FADRPAFAS | (SEQ ID NO: 5214) |
| 88 | RLGSCPIVV | (SEQ ID NO: 5215) |
| 63 | AAAVGQAAH | (SEQ ID NO: 5216) |
| 55 | FAWPLIGNA | (SEQ ID NO: 5217) |

-continued

| | | |
|---|---|---|
| 52 | PGPFAWPLI | (SEQ ID NO: 5218) |
| 50 | APPGPFAWP | (SEQ ID NO: 5219) |
| 47 | LRSAPPGPF | (SEQ ID NO: 5220) |
| 42 | QRRRQLRSA | (SEQ ID NO: 5221) |
| 38 | RLLRQRRRQ | (SEQ ID NO: 5222) |
| 30 | LATVHVGQR | (SEQ ID NO: 5223) |
| 25 | LLLSVLATV | (SEQ ID NO: 5224) |
| 14 | NPLSIQQTT | (SEQ ID NO: 5225) |
| 12 | PLNPLSIQQ | (SEQ ID NO: 5226) |
| 11 | WPLNPLSIQ | (SEQ ID NO: 5227) |
| 506 | SYGLTIKPK | (SEQ ID NO: 5228) |
| 494 | RANPNEPAK | (SEQ ID NO: 5229) |
| 483 | FLSLLAHQC | (SEQ ID NO: 5230) |
| 461 | MIFSVGKRR | (SEQ ID NO: 5231) |
| 404 | TANTSVLGY | (SEQ ID NO: 5232) |
| 398 | TIPHATTAN | (SEQ ID NO: 5233) |
| 382 | LAFLYEAMR | (SEQ ID NO: 5234) |
| 329 | GASQDTLST | (SEQ ID NO: 5235) |
| 323 | TLTDLFGAS | (SEQ ID NO: 5236) |
| 294 | DAFILSAEK | (SEQ ID NO: 5237) |
| 132 | MAFGHYSEH | (SEQ ID NO: 5238) |
| 105 | QALVQQGSA | (SEQ ID NO: 5239) |
| 102 | AIHQALVQQ | (SEQ ID NO: 5240) |
| 68 | QAAHLSFAR | (SEQ ID NO: 5241) |
| 62 | NAAAVGQAA | (SEQ ID NO: 5242) |
| 533 | VQNLQAKET | (SEQ ID NO: 5243) |
| 525 | SMELLDSAV | (SEQ ID NO: 5244) |
| 524 | ESMELLDSA | (SEQ ID NO: 5245) |
| 487 | LAHQCDFRA | (SEQ ID NO: 5246) |
| 471 | IGEELSKMQ | (SEQ ID NO: 5247) |
| 451 | LINKDLTSR | (SEQ ID NO: 5248) |
| 392 | SSFVPVTIP | (SEQ ID NO: 5249) |
| 326 | DIFGASQDT | (SEQ ID NO: 5250) |
| 321 | PATLTDLFG | (SEQ ID NO: 5251) |
| 315 | LDLENVPAT | (SEQ ID NO: 5252) |
| 62 | NAAAVGQAA | (SEQ ID NO: 5253) |
| 113 | AFADRPAFA | (SEQ ID NO: 5254) |
| 530 | DSAVQNLQA | (SEQ ID NO: 5255) |
| 493 | FRANPNEPA | (SEQ ID NO: 5256) |
| 287 | AAPRDMMDA | (SEQ ID NO: 5257) |
| 111 | GSAFADRPA | (SEQ ID NO: 5258) |
| 67 | GQAAHLSFA | (SEQ ID NO: 5259) |
| 61 | GNAAAVGQA | (SEQ ID NO: 5260) |
| 48 | RSAPPGPFA | (SEQ ID NO: 5261) |
| 487 | LAHQCDFRA | (SEQ ID NO: 5262) |
| 199 | VAVANVMSA | (SEQ ID NO: 5263) |
| 178 | VALLVRGSA | (SEQ ID NO: 5264) |
| 105 | QALVQQGSA | (SEQ ID NO: 5265) |
| 55 | FAWPLIGNA | (SEQ ID NO: 5266) |
| 330 | ASQDTLSTA | (SEQ ID NO: 5267) |
| 322 | ATLTDLFGA | (SEQ ID NO: 5268) |
| 305 | AGDSHGGGA | (SEQ ID NO: 5269) |
| 70 | AHLSFARLA | (SEQ ID NO: 5270) |
| 56 | AWPLIGNAA | (SEQ ID NO: 5271) |
| 524 | ESMELLDSA | (SEQ ID NO: 5272) |
| 480 | LFLFLSLLA | (SEQ ID NO: 5273) |
| 435 | PNPENFDPA | (SEQ ID NO: 5274) |
| 397 | VTIPHATTA | (SEQ ID NO: 5275) |
| 394 | FVPVTIPHA | (SEQ ID NO: 5276) |
| 380 | YVLAFLYEA | (SEQ ID NO: 5277) |
| 375 | QPNLPYVLA | (SEQ ID NO: 5278) |
| 350 | PDVQTRVQA | (SEQ ID NO: 5279) |
| 314 | RLDLENVPA | (SEQ ID NO: 5280) |
| 297 | ILSAEKKAA | (SEQ ID NO: 5281) |
| 296 | FILSAEKKA | (SEQ ID NO: 5282) |
| 292 | MMDAFILSA | (SEQ ID NO: 5283) |
| 280 | CESLRPGAA | (SEQ ID NO: 5284) |
| 279 | HCESLRPGA | (SEQ ID NO: 5285) |
| 229 | EEFGRTVGA | (SEQ ID NO: 5286) |
| 194 | RPLTVVAVA | (SEQ ID NO: 5287) |
| 192 | DPRPLTVVA | (SEQ ID NO: 5288) |
| 181 | LVRGSADGA | (SEQ ID NO: 5289) |
| 171 | LSEARELVA | (SEQ ID NO: 5290) |
| 166 | LEGHVLSEA | (SEQ ID NO: 5291) |
| 140 | HWKVQRRAA | (SEQ ID NO: 5292) |
| 139 | EHWKVQRRA | (SEQ ID NO: 5293) |
| 125 | VVSGGRSMA | (SEQ ID NO: 5294) |
| 107 | LVQQGSAFA | (SEQ ID NO: 5295) |
| 98 | NGERAIHQA | (SEQ ID NO: 5296) |
| 94 | IVVLNGERA | (SEQ ID NO: 5297) |
| 57 | WPLIGNAAA | (SEQ ID NO: 5298) |
| 42 | QRRRQLRSA | (SEQ ID NO: 5299) |
| 23 | LLLLLSVLA | (SEQ ID NO: 5300) |
| 63 | AAAVGQAAH | (SEQ ID NO: 5301) |
| 303 | KAAGDSHGG | (SEQ ID NO: 5302) |
| 286 | GAAPRDMMD | (SEQ ID NO: 5303) |
| 146 | RAAHSMMRN | (SEQ ID NO: 5304) |
| 68 | QAAHLSFAR | (SEQ ID NO: 5305) |
| 200 | AVANVMSAV | (SEQ ID NO: 5306) |
| 194 | RPLTVVAVA | (SEQ ID NO: 5307) |
| 191 | LDPRPLTVV | (SEQ ID NO: 5308) |
| 151 | MMRNFFTRQ | (SEQ ID NO: 5309) |
| 98 | NGERAIHQA | (SEQ ID NO: 5310) |
| 82 | GDVFQIRLG | (SEQ ID NO: 5311) |
| 30 | LATVHVGQR | (SEQ ID NO: 5312) |
| 11 | WPLNPLSIQ | (SEQ ID NO: 5313) |
| 523 | RESMELLDS | (SEQ ID NO: 5314) |
| 512 | KPKSFKVNV | (SEQ ID NO: 5315) |
| 506 | SYGLTIKPK | (SEQ ID NO: 5316) |
| 505 | FSYGLTIKP | (SEQ ID NO: 5317) |
| 494 | RANPNEPAK | (SEQ ID NO: 5318) |
| 491 | CDFRANPNE | (SEQ ID NO: 5319) |
| 477 | KMQLFLFIS | (SEQ ID NO: 5320) |
| 471 | IGEELSKMQ | (SEQ ID NO: 5321) |
| 429 | HDPLKWPNP | (SEQ ID NO: 5322) |
| 428 | NHDPLKWPN | (SEQ ID NO: 5323) |
| 407 | TSVLGYHIP | (SEQ ID NO: 5324) |
| 382 | LAFLYEAMR | (SEQ ID NO: 5325) |
| 379 | PYVLAFLYE | (SEQ ID NO: 5326) |
| 325 | TDIFGASQO | (SEQ ID NO: 5327) |
| 310 | GGGARLDLE | (SEQ ID NO: 5328) |
| 303 | KAAGDSHGG | (SEQ ID NO: 5329) |
| 299 | SAEKKAAGD | (SEQ ID NO: 5330) |
| 279 | HCESLRPGA | (SEQ ID NO: 5331) |
| 186 | ADGAFLDPR | (SEQ ID NO: 5332) |
| 175 | RELVALLVR | (SEQ ID NO: 5333) |
| 150 | SMMRNFFTR | (SEQ ID NO: 5334) |
| 108 | VQQGSAFAD | (SEQ ID NO: 5335) |
| 87 | IRLGSCPIV | (SEQ ID NO: 5336) |
| 85 | FQIRLGSCP | (SEQ ID NO: 5337) |
| 49 | SAPPGPFAW | (SEQ ID NO: 5338) |
| 48 | RSAPPGPFA | (SEQ ID NO: 5339) |
| 43 | RRRQLRSAP | (SEQ ID NO: 5340) |
| 7 | PNDPWPLNP | (SEQ ID NO: 5341) |
| 1 | MGTSLSPND | (SEQ ID NO: 5342) |
| 525 | SMELLDSAV | (SEQ ID NO: 5343) |
| 503 | MNFSYGLTI | (SEQ ID NO: 5344) |
| 496 | NPNEPAKMN | (SEQ ID NO: 5345) |
| 489 | HQCDFRANP | (SEQ ID NO: 5346) |
| 484 | ISILAHQCD | (SEQ ID NO: 5347) |
| 463 | FSVGKRRCI | (SEQ ID NO: 5348) |
| 454 | KDLTSRVMI | (SEQ ID NO: 5349) |
| 365 | GRDRLPCMG | (SEQ ID NO: 5350) |
| 350 | PDVQTRVQA | (SEQ ID NO: 5351) |
| 348 | RYPDVQTRV | (SEQ ID NO: 5352) |
| 328 | FGASQDTLS | (SEQ ID NO: 5353) |
| 311 | GGARLDLEN | (SEQ ID NO: 5354) |
| 305 | AGDSHGGGA | (SEQ ID NO: 5355) |
| 304 | AAGDSHGGG | (SEQ ID NO: 5356) |
| 302 | KKAAGDSHG | (SEQ ID NO: 5357) |
| 215 | SHDDPEFRE | (SEQ ID NO: 5358) |
| 168 | GHVLSEARE | (SEQ ID NO: 5359) |
| 157 | TRQPRSRQV | (SEQ ID NO: 5360) |
| 153 | RNFFTRQPR | (SEQ ID NO: 5361) |
| 145 | RRAAHSMMR | (SEQ ID NO: 5362) |
| 141 | WKVQRRAAH | (SEQ ID NO: 5363) |
| 140 | HWKVQRRAA | (SEQ ID NO: 5364) |
| 154 | NFFTRQPRS | (SEQ ID NO: 5365) |
| 141 | WKVQRRAAH | (SEQ ID NO: 5366) |
| 138 | SEHWKVQRR | (SEQ ID NO: 5367) |
| 123 | FRVVSGGRS | (SEQ ID NO: 5368) |
| 117 | RPAFASFRV | (SEQ ID NO: 5369) |
| 113 | AFADRPAFA | (SEQ ID NO: 5370) |
| 110 | QGSAFADRP | (SEQ ID NO: 5371) |
| 102 | AIHQALVQQ | (SEQ ID NO: 5372) |
| 88 | RLGSCPIVV | (SEQ ID NO: 5373) |
| 78 | ARRYGDVFQ | (SEQ ID NO: 5374) |
| 74 | FARLARRYG | (SEQ ID NO: 5375) |

-continued

| | | |
|---|---|---|
| 71 | HLSFARLAR | (SEQ ID NO: 5376) |
| 61 | GNAAAVGQA | (SEQ ID NO: 5377) |
| 58 | PLIGNAAAV | (SEQ ID NO: 5378) |
| 55 | FAWPLIGNA | (SEQ ID NO: 5379) |
| 43 | RRRQLRSAP | (SEQ ID NO: 5380) |
| 34 | HVGQRLLRQ | (SEQ ID NO: 5381) |
| 29 | VLATVHVGQ | (SEQ ID NO: 5382) |
| 28 | SVLATVHVG | (SEQ ID NO: 5383) |
| 9 | DPWPLNPLS | (SEQ ID NO: 5384) |
| 7 | PNDPWPLNP | (SEQ ID NO: 5385) |
| 6 | SPNDPWPLN | (SEQ ID NO: 5386) |
| 2 | GTSLSPNDP | (SEQ ID NO: 5387) |
| 530 | DSAVQNLQA | (SEQ ID NO: 5388) |
| 526 | MELLDSAVQ | (SEQ ID NO: 5389) |
| 525 | SMELLDSAV | (SEQ ID NO: 5390) |
| 524 | ESMELLDSA | (SEQ ID NO: 5391) |
| 516 | FKVNVTLRE | (SEQ ID NO: 5392) |
| 504 | NFSYGLTIK | (SEQ ID NO: 5393) |
| 496 | NPNEPAKMN | (SEQ ID NO: 5394) |
| 493 | FRANPNEPA | (SEQ ID NO: 5395) |
| 489 | HQCDFRANP | (SEQ ID NO: 5396) |
| 484 | ISILAHQCD | (SEQ ID NO: 5397) |
| 481 | FLFLSLLAH | (SEQ ID NO: 5398) |
| 464 | SVGKRRCIG | (SEQ ID NO: 5399) |
| 461 | MIFSVGKRR | (SEQ ID NO: 5400) |
| 459 | RVMIFSVGK | (SEQ ID NO: 5401) |
| 458 | SRVMIFSVG | (SEQ ID NO: 5402) |
| 456 | LTSRVMIFS | (SEQ ID NO: 5403) |
| 450 | GLINKDLTS | (SEQ ID NO: 5404) |
| 449 | DGLINKDLT | (SEQ ID NO: 5405) |
| 447 | DKDGLINKD | (SEQ ID NO: 5406) |
| 446 | LDKDGLINK | (SEQ ID NO: 5407) |
| 435 | PNPENFDPA | (SEQ ID NO: 5408) |
| 434 | WPNPENFDP | (SEQ ID NO: 5409) |
| 430 | DPLKWPNPE | (SEQ ID NO: 5410) |
| 427 | VNHDPLKWP | (SEQ ID NO: 5411) |
| 420 | VFVNQWSVN | (SEQ ID NO: 5412) |
| 419 | VVFVNQWSV | (SEQ ID NO: 5413) |
| 417 | DTVVFVNQW | (SEQ ID NO: 5414) |
| 409 | VLGYHIPKD | (SEQ ID NO: 5415) |
| 407 | TSVLGYHIP | (SEQ ID NO: 5416) |
| 406 | NTSVLGYHI | (SEQ ID NO: 5417) |
| 404 | TANTSVLGY | (SEQ ID NO: 5418) |
| 399 | IPHATTANT | (SEQ ID NO: 5419) |
| 398 | TIPHATTAN | (SEQ ID NO: 5420) |
| 396 | PVTIPHATT | (SEQ ID NO: 5421) |
| 395 | VPVTIPHAT | (SEQ ID NO: 5422) |
| 304 | AAGDSHGGG | (SEQ ID NO: 5423) |
| 303 | KAAGDSHGG | (SEQ ID NO: 5424) |
| 287 | AAPRDMMDA | (SEQ ID NO: 5425) |
| 230 | EFGRTVGAG | (SEQ ID NO: 5426) |
| 226 | SHNEEFGRT | (SEQ ID NO: 5427) |
| 198 | VVAVANVMS | (SEQ ID NO: 5428) |
| 193 | PRPLTVVAV | (SEQ ID NO: 5429) |
| 167 | EGHVLSEAR | (SEQ ID NO: 5430) |
| 146 | RAAHSMMRN | (SEQ ID NO: 5431) |
| 136 | HYSEHWKVQ | (SEQ ID NO: 5432) |
| 118 | PAFASFRVV | (SEQ ID NO: 5433) |
| 101 | RALHQALVQ | (SEQ ID NO: 5434) |
| 59 | LIGNAAAVG | (SEQ ID NO: 5435) |
| 394 | FVPVTIPHA | (SEQ ID NO: 5436) |
| 356 | VQAELDQVV | (SEQ ID NO: 5437) |
| 281 | ESLRPGAAP | (SEQ ID NO: 5438) |
| 238 | GSLVDVMPW | (SEQ ID NO: 5439) |
| 227 | HNEEFGRTV | (SEQ ID NO: 5440) |
| 164 | QVLEGHVLS | (SEQ ID NO: 5441) |
| 162 | SRQVLEGHV | (SEQ ID NO: 5442) |
| 91 | SCPIVVLNG | (SEQ ID NO: 5443) |
| 90 | GSCPIVVLN | (SEQ ID NO: 5444) |
| 28 | SVLATVHVG | (SEQ ID NO: 5445) |
| 530 | DSAVQNLQA | (SEQ ID NO: 5446) |
| 517 | KVNVTLRES | (SEQ ID NO: 5447) |
| 511 | IKPKSFKVN | (SEQ ID NO: 5448) |
| 493 | FRANPNEPA | (SEQ ID NO: 5449) |
| 484 | ISILAHQCD | (SEQ ID NO: 5450) |
| 462 | IFSVGKRRC | (SEQ ID NO: 5451) |
| 460 | VMIFSVGKR | (SEQ ID NO: 5452) |
| 458 | SRVMIFSVG | (SEQ ID NO: 5453) |
| 435 | PNPENFDPA | (SEQ ID NO: 5454) |

-continued

| | | |
|---|---|---|
| 427 | VNHDPLKWP | (SEQ ID NO: 5455) |
| 426 | SVNHDPLKW | (SEQ ID NO: 5456) |
| 422 | VNQWSVNHD | (SEQ ID NO: 5457) |
| 421 | FVNQWSVNH | (SEQ ID NO: 5458) |
| 419 | VVFVNQWSV | (SEQ ID NO: 5459) |
| 417 | DTVVFVNQW | (SEQ ID NO: 5460) |
| 416 | KDTVVFVNQ | (SEQ ID NO: 5461) |
| 408 | SVLGYHIPK | (SEQ ID NO: 5462) |
| 393 | SFVPVTIPH | (SEQ ID NO: 5463) |
| 358 | AELDQVVGR | (SEQ ID NO: 5464) |
| 318 | ENVPATITD | (SEQ ID NO: 5465) |
| 311 | GGARLDLEN | (SEQ ID NO: 5466) |
| 308 | SHGGGARLD | (SEQ ID NO: 5467) |
| 306 | GDSHGGGAR | (SEQ ID NO: 5468) |
| 278 | RHCESLRPG | (SEQ ID NO: 5469) |
| 261 | FEQLNRNFS | (SEQ ID NO: 5470) |
| 259 | REFEQLNRN | (SEQ ID NO: 5471) |
| 254 | VRTVFREFE | (SEQ ID NO: 5472) |
| 237 | AGSLVDVMP | (SEQ ID NO: 5473) |
| 235 | VGAGSLVDV | (SEQ ID NO: 5474) |
| 222 | RELLSHNEE | (SEQ ID NO: 5475) |
| 221 | FRELLSHNE | (SEQ ID NO: 5476) |
| 215 | SHDDPEFRE | (SEQ ID NO: 5477) |
| 196 | LTVVAVANV | (SEQ ID NO: 5478) |
| 177 | LVALLVRGS | (SEQ ID NO: 5479) |
| 168 | GHVLSEARE | (SEQ ID NO: 5480) |
| 119 | AFASFRVVS | (SEQ ID NO: 5481) |
| 499 | EPAKMNFSY | (SEQ ID NO: 5482) |
| 486 | ILAHQCDFR | (SEQ ID NO: 5483) |
| 441 | DPARFLDKD | (SEQ ID NO: 5484) |
| 403 | TTANTSVLG | (SEQ ID NO: 5485) |
| 400 | PHATTANTS | (SEQ ID NO: 5486) |
| 386 | YEAMRFSSF | (SEQ ID NO: 5487) |
| 381 | VLAFLYEAM | (SEQ ID NO: 5488) |
| 356 | VQAELDQVV | (SEQ ID NO: 5489) |
| 336 | STALQWLLL | (SEQ ID NO: 5490) |
| 328 | FGASQDTLS | (SEQ ID NO: 5491) |
| 320 | VPATLTDLF | (SEQ ID NO: 5492) |
| 311 | GGARLDLEN | (SEQ ID NO: 5493) |
| 304 | AAGDSHGGG | (SEQ ID NO: 5494) |
| 302 | KKAAGDSHG | (SEQ ID NO: 5495) |
| 298 | LSAEKKAAG | (SEQ ID NO: 5496) |
| 293 | MDAFILSAE | (SEQ ID NO: 5497) |
| 285 | PGAAPRDMM | (SEQ ID NO: 5498) |
| 235 | VGAGSLVDV | (SEQ ID NO: 5499) |
| 205 | MSAVCFGCR | (SEQ ID NO: 5500) |
| 198 | VVAVANVMS | (SEQ ID NO: 5501) |
| 187 | DGAFLDPRP | (SEQ ID NO: 5502) |
| 184 | GSADGAFLD | (SEQ ID NO: 5503) |
| 177 | LVALLVRGS | (SEQ ID NO: 5504) |
| 172 | SEARELVAL | (SEQ ID NO: 5505) |
| 147 | AAHSMMRNF | (SEQ ID NO: 5506) |
| 145 | RRAAHSMMR | (SEQ ID NO: 5507) |
| 131 | SMAFGHYSE | (SEQ ID NO: 5508) |
| 117 | RPAFASFRV | (SEQ ID NO: 5509) |
| 104 | HQALVQQGS | (SEQ ID NO: 5510) |
| 100 | ERAIHQALV | (SEQ ID NO: 5511) |
| 76 | RLARRYGDV | (SEQ ID NO: 5512) |
| 73 | SFARLARRY | (SEQ ID NO: 5513) |
| 69 | AAHLSFARL | (SEQ ID NO: 5514) |
| 64 | AAVGQAAHL | (SEQ ID NO: 5515) |
| 54 | PFAWPLIGN | (SEQ ID NO: 5516) |
| 29 | VLATVHVGQ | (SEQ ID NO: 5517) |
| 531 | SAVQNLQAK | (SEQ ID NO: 5518) |
| 500 | PAKMNFSYG | (SEQ ID NO: 5519) |
| 494 | RANPNEPAK | (SEQ ID NO: 5520) |
| 442 | PARFLDKDG | (SEQ ID NO: 5521) |
| 404 | TANTSVLGY | (SEQ ID NO: 5522) |
| 401 | HATTANTSV | (SEQ ID NO: 5523) |
| 387 | EAMRFSSFV | (SEQ ID NO: 5524) |
| 382 | LAFLYEAMR | (SEQ ID NO: 5525) |
| 357 | QAELDQVVG | (SEQ ID NO: 5526) |
| 337 | TALQWLLLL | (SEQ ID NO: 5527) |
| 329 | GASQDTLST | (SEQ ID NO: 5528) |
| 321 | PATLTDLFG | (SEQ ID NO: 5529) |
| 312 | GARLDLENV | (SEQ ID NO: 5530) |
| 299 | SAEKKAAGD | (SEQ ID NO: 5531) |
| 294 | DAFILSAEK | (SEQ ID NO: 5532) |
| 236 | GAGSLVDVM | (SEQ ID NO: 5533) |

| 206 | SAVCFGCRY | (SEQ ID NO: 5534) |
| 201 | VANVMSAVC | (SEQ ID NO: 5535) |
| 188 | GAFLDPRPL | (SEQ ID NO: 5536) |
| 185 | SADGAFLDP | (SEQ ID NO: 5537) |
| 173 | EARELVALL | (SEQ ID NO: 5538) |
| 132 | MAFGHYSEH | (SEQ ID NO: 5539) |
| 104 | HQALVQQGS | (SEQ ID NO: 5540) |
| 101 | RAIHQALVQ | (SEQ ID NO: 5541) |
| 97 | LNGERAIHQ | (SEQ ID NO: 5542) |
| 68 | QAAHLSFAR | (SEQ ID NO: 5543) |
| 63 | AAAVGQAAH | (SEQ ID NO: 5544) |
| 62 | NAAAVGQAA | (SEQ ID NO: 5545) |
| 36 | GQRLLRQRR | (SEQ ID NO: 5546) |
| 33 | VHVGQRLLR | (SEQ ID NO: 5547) |
| 533 | VQNLQAKET | (SEQ ID NO: 5548) |
| 507 | YGLTIKPKS | (SEQ ID NO: 5549) |
| 487 | LAHQCDFRA | (SEQ ID NO: 5550) |
| 465 | VGKRRCIGE | (SEQ ID NO: 5551) |
| 436 | NPENFDPAR | (SEQ ID NO: 5552) |
| 434 | WPNPENFDP | (SEQ ID NO: 5553) |
| 399 | IPHATTANT | (SEQ ID NO: 5554) |
| 371 | CMGDQPNLP | (SEQ ID NO: 5555) |
| 366 | RDRLPCMGD | (SEQ ID NO: 5556) |
| 349 | YPDVQTRVQ | (SEQ ID NO: 5557) |
| 332 | QDTLSTALQ | (SEQ ID NO: 5558) |
| 329 | GASQDTLST | (SEQ ID NO: 5559) |
| 313 | ARLDLENVP | (SEQ ID NO: 5560) |
| 308 | SHGGGARLD | (SEQ ID NO: 5561) |
| 300 | AEKKAAGDS | (SEQ ID NO: 5562) |
| 289 | PRDMMDAFI | (SEQ ID NO: 5563) |
| 273 | LDKFLRHCE | (SEQ ID NO: 5564) |
| 251 | PNPVRTVFR | (SEQ ID NO: 5565) |
| 243 | VMPWLQYFP | (SEQ ID NO: 5566) |
| 237 | AGSLVDVMP | (SEQ ID NO: 5567) |
| 231 | FGRTVGAGS | (SEQ ID NO: 5568) |
| 227 | HNEEFGRTV | (SEQ ID NO: 5569) |
| 222 | RELLSHNEE | (SEQ ID NO: 5570) |
| 221 | FRELLSHNE | (SEQ ID NO: 5571) |
| 184 | GSADGAFLD | (SEQ ID NO: 5572) |
| 162 | SRQVLEGHV | (SEQ ID NO: 5573) |
| 159 | QPRSRQVLE | (SEQ ID NO: 5574) |
| 137 | YSEHWKVQR | (SEQ ID NO: 5575) |
| 136 | HYSEHWKVQ | (SEQ ID NO: 5576) |
| 135 | GHYSEHWKV | (SEQ ID NO: 5577) |
| 131 | SMAFGHYSE | (SEQ ID NO: 5578) |
| 128 | GGRSMAFGH | (SEQ ID NO: 5579) |
| 123 | FRVVSGGRS | (SEQ ID NO: 5580) |
| 117 | RPAFASFRV | (SEQ ID NO: 5581) |
| 114 | FADRPAFAS | (SEQ ID NO: 5582) |
| 105 | QALVQQGSA | (SEQ ID NO: 5583) |
| 60 | IGNAAAVGQ | (SEQ ID NO: 5584) |
| 57 | WPLIGNAAA | (SEQ ID NO: 5585) |
| 56 | AWPLIGNAA | (SEQ ID NO: 5586) |
| 53 | GPFAWPLIG | (SEQ ID NO: 5587) |
| 52 | PGPFAWPLI | (SEQ ID NO: 5588) |
| 45 | RQLRSAPPG | (SEQ ID NO: 5589) |
| 27 | LSVLATVHV | (SEQ ID NO: 5590) |
| 14 | NPLSIQQTT | (SEQ ID NO: 5591) |
| 10 | PWPLNPLSI | (SEQ ID NO: 5592) |
| 6 | SPNDPWPLN | (SEQ ID NO: 5593) |
| 534 | QNLQAKETC | (SEQ ID NO: 5594) |
| 526 | MELLDSAVJ | (SEQ ID NO: 5595) |
| 522 | LRESMELLD | (SEQ ID NO: 5596) |
| 516 | FKVNVTLRE | (SEQ ID NO: 5597) |
| 493 | FRANPNEPA | (SEQ ID NO: 5598) |
| 393 | SFVPVTIPH | (SEQ ID NO: 5599) |
| 389 | MRFSSFVPV | (SEQ ID NO: 5600) |
| 388 | AMRFSSFVP | (SEQ ID NO: 5601) |
| 385 | LYEAMRFSS | (SEQ ID NO: 5602) |
| 380 | YVLAFLYEA | (SEQ ID NO: 5603) |
| 372 | MGDQPNLPY | (SEQ ID NO: 5604) |
| 371 | CMGDQPNLP | (SEQ ID NO: 5605) |
| 365 | GRDRLPCMG | (SEQ ID NO: 5606) |
| 354 | TRVQAELDQ | (SEQ ID NO: 5607) |
| 351 | DVQTRVQAE | (SEQ ID NO: 5608) |
| 342 | LLLLFTRYP | (SEQ ID NO: 5609) |
| 341 | WLLLLFTRY | (SEQ ID NO: 5610) |
| 330 | ASQDTLSTA | (SEQ ID NO: 5611) |
| 325 | TDIFGASQD | (SEQ ID NO: 5612) |
| 324 | ITDIFGASQ | (SEQ ID NO: 5613) |
| 317 | LENVPATIT | (SEQ ID NO: 5614) |
| 314 | RLDLENVPA | (SEQ ID NO: 5615) |
| 303 | KAAGDSHGG | (SEQ ID NO: 5616) |
| 302 | KKAAGDSHG | (SEQ ID NO: 5617) |
| 299 | SAEKKAAGD | (SEQ ID NO: 5618) |
| 293 | MDAFILSAE | (SEQ ID NO: 5619) |
| 277 | LRHCESLRP | (SEQ ID NO: 5620) |
| 267 | NFSNFILDK | (SEQ ID NO: 5621) |
| 261 | FEQLNRNFS | (SEQ ID NO: 5622) |
| 254 | VRTVFREFE | (SEQ ID NO: 5623) |
| 245 | PWLQYFPNP | (SEQ ID NO: 5624) |
| 240 | LVDVMPWLQ | (SEQ ID NO: 5625) |
| 224 | LLSHNEEFG | (SEQ ID NO: 5626) |
| 220 | EFRELLSHN | (SEQ ID NO: 5627) |
| 208 | VCFGCRYSH | (SEQ ID NO: 5628) |
| 206 | SAVCFGCRY | (SEQ ID NO: 5629) |
| 205 | MSAVCFGCR | (SEQ ID NO: 5630) |
| 199 | VAVANVMSA | (SEQ ID NO: 5631) |
| 196 | LTVVAVANV | (SEQ ID NO: 5632) |
| 179 | ALLVRGSAD | (SEQ ID NO: 5633) |
| 159 | QPRSRQVLE | (SEQ ID NO: 5634) |
| 152 | MRNFFTRQP | (SEQ ID NO: 5635) |
| 151 | MMRNFFTRQ | (SEQ ID NO: 5636) |
| 150 | SMMRNFFTR | (SEQ ID NO: 5637) |
| 132 | MAFGHYSEH | (SEQ ID NO: 5638) |
| 131 | SMAFGHYSE | (SEQ ID NO: 5639) |
| 129 | GRSMAFGHY | (SEQ ID NO: 5640) |
| 114 | FADRPAFAS | (SEQ ID NO: 5641) |
| 108 | VQQGSAFAD | (SEQ ID NO: 5642) |
| 107 | LVQQGSAFA | (SEQ ID NO: 5643) |
| 101 | RAIHQALVQ | (SEQ ID NO: 5644) |
| 100 | ERAIHQALV | (SEQ ID NO: 5645) |
| 98 | NGERAIHQA | (SEQ ID NO: 5646) |
| 96 | VLNGERAIH | (SEQ ID NO: 5647) |
| 93 | PIVVLNGER | (SEQ ID NO: 5648) |
| 83 | DVFQIRLGS | (SEQ ID NO: 5649) |
| 79 | RRYGDVFQI | (SEQ ID NO: 5650) |
| 72 | LSFARLARR | (SEQ ID NO: 5651) |
| 68 | QAAHLSFAR | (SEQ ID NO: 5652) |
| 67 | GQAAHLSFA | (SEQ ID NO: 5653) |
| 62 | NAAAVGQAA | (SEQ ID NO: 5654) |
| 59 | LIGNAAAVG | (SEQ ID NO: 5655) |
| 57 | WPLIGNAAA | (SEQ ID NO: 5656) |
| 54 | PFAWPLIGN | (SEQ ID NO: 5657) |
| 160 | PRSRQVLEG | (SEQ ID NO: 5658) |
| 150 | SMMRNFFTR | (SEQ ID NO: 5659) |
| 139 | EHWKVQRRA | (SEQ ID NO: 5660) |
| 134 | FGHYSEHWK | (SEQ ID NO: 5661) |
| 131 | SMAFGHYSE | (SEQ ID NO: 5662) |
| 127 | SGGRSMAFG | (SEQ ID NO: 5663) |
| 123 | FRVVSGGRS | (SEQ ID NO: 5664) |
| 108 | VQQGSAFAD | (SEQ ID NO: 5665) |
| 104 | HQALVQQGS | (SEQ ID NO: 5666) |
| 103 | IHQALVQQG | (SEQ ID NO: 5667) |
| 100 | ERAIHQALV | (SEQ ID NO: 5668) |
| 94 | IVVLNGERA | (SEQ ID NO: 5669) |
| 82 | GDVFQIRLG | (SEQ ID NO: 5670) |
| 73 | SFARLARRY | (SEQ ID NO: 5671) |
| 61 | GNAAAVGQA | (SEQ ID NO: 5672) |
| 60 | IGNAAAVGQ | (SEQ ID NO: 5673) |
| 56 | AWPLIGNAA | (SEQ ID NO: 5674) |
| 27 | LSVLATVHV | (SEQ ID NO: 5675) |
| 13 | LNPLSIQQT | (SEQ ID NO: 5676) |
| 2 | GTSLSPNDP | (SEQ ID NO: 5677) |
| 526 | MELLDSAVQ | (SEQ ID NO: 5678) |
| 518 | VNVTLRESM | (SEQ ID NO: 5679) |
| 516 | FKVNVTLRE | (SEQ ID NO: 5680) |
| 505 | FSYGLTIKP | (SEQ ID NO: 5681) |
| 504 | NFSYGLTIK | (SEQ ID NO: 5682) |
| 491 | CDFRANPNE | (SEQ ID NO: 5683) |
| 489 | HQCDFRANP | (SEQ ID NO: 5684) |
| 488 | AHQCDFRAN | (SEQ ID NO: 5685) |
| 477 | KMQLFLFIS | (SEQ ID NO: 5686) |
| 459 | RVMIFSVGK | (SEQ ID NO: 5687) |
| 453 | NKDLTSRVM | (SEQ ID NO: 5688) |
| 447 | DKDGLINKD | (SEQ ID NO: 5689) |
| 423 | NQWSVNHDP | (SEQ ID NO: 5690) |
| 420 | VFVNQWSVN | (SEQ ID NO: 5691) |

-continued

| | | |
|---|---|---|
| 418 | TVVFVNQWS | (SEQ ID NO: 5692) |
| 415 | PKDTVVFVN | (SEQ ID NO: 5693) |
| 411 | GYHIPKDTV | (SEQ ID NO: 5694) |
| 410 | LGYHIPKDT | (SEQ ID NO: 5695) |
| 407 | TSVLGYHIP | (SEQ ID NO: 5696) |
| 403 | TTANTSVLG | (SEQ ID NO: 5697) |
| 397 | VTIPHATTA | (SEQ ID NO: 5698) |
| 390 | RFSSFVPVT | (SEQ ID NO: 5699) |
| 389 | MRFSSFVPV | (SEQ ID NO: 5700) |
| 380 | YVLAFLYEA | (SEQ ID NO: 5701) |
| 379 | PYVLAFLYE | (SEQ ID NO: 5702) |
| 373 | GDQPNLPYV | (SEQ ID NO: 5703) |
| 372 | MGDQPNLPY | (SEQ ID NO: 5704) |
| 365 | GRDRLPCMG | (SEQ ID NO: 5705) |
| 363 | VVGRDRLPC | (SEQ ID NO: 5706) |
| 360 | LDQVVGRDR | (SEQ ID NO: 5707) |
| 350 | PDVQTRVQA | (SEQ ID NO: 5708) |
| 347 | TRYPDVQTR | (SEQ ID NO: 5709) |
| 340 | QWLLLLFTR | (SEQ ID NO: 5710) |
| 339 | LQWLLLLFT | (SEQ ID NO: 5711) |
| 332 | QDTLSTALQ | (SEQ ID NO: 5712) |
| 328 | FGASQDTLS | (SEQ ID NO: 5713) |
| 324 | ITDIFGASQ | (SEQ ID NO: 5714) |
| 322 | ATLTDLFGA | (SEQ ID NO: 5715) |
| 317 | LENVPATIT | (SEQ ID NO: 5716) |
| 120 | FASFRVVSG | (SEQ ID NO: 5717) |
| 118 | PAFASFRVV | (SEQ ID NO: 5718) |
| 114 | FADRPAFAS | (SEQ ID NO: 5719) |
| 112 | SAFADRPAF | (SEQ ID NO: 5720) |
| 101 | RAIHQALVQ | (SEQ ID NO: 5721) |
| 77 | LARRYGDVF | (SEQ ID NO: 5722) |
| 74 | FARLARRYG | (SEQ ID NO: 5723) |
| 49 | SAPPGPFAW | (SEQ ID NO: 5724) |
| 30 | LATVHVGQR | (SEQ ID NO: 5725) |
| 532 | AVQNLQAKE | (SEQ ID NO: 5726) |
| 501 | AKMNFSYGL | (SEQ ID NO: 5727) |
| 495 | ANPNEPAKM | (SEQ ID NO: 5728) |
| 488 | AHQCDFRAN | (SEQ ID NO: 5729) |
| 443 | ARFLDKDGL | (SEQ ID NO: 5730) |
| 405 | ANTSVLGYH | (SEQ ID NO: 5731) |
| 402 | ATTANTSVL | (SEQ ID NO: 5732) |
| 388 | AMRFSSFVP | (SEQ ID NO: 5733) |
| 383 | AFLYEAMRF | (SEQ ID NO: 5734) |
| 358 | AELDQVVGR | (SEQ ID NO: 5735) |
| 338 | ALQWLLLLF | (SEQ ID NO: 5736) |
| 313 | ARLDLENVP | (SEQ ID NO: 5737) |
| 300 | AEKKAAGDS | (SEQ ID NO: 5738) |
| 295 | AFILSAEKK | (SEQ ID NO: 5739) |
| 288 | APRDMMDAF | (SEQ ID NO: 5740) |
| 237 | AGSLVDVMP | (SEQ ID NO: 5741) |
| 207 | AVCFGCRYS | (SEQ ID NO: 5742) |
| 202 | ANVMSAVCF | (SEQ ID NO: 5743) |
| 189 | AFLDPRPLT | (SEQ ID NO: 5744) |
| 186 | ADGAFLDPR | (SEQ ID NO: 5745) |
| 179 | ALLVRGSAD | (SEQ ID NO: 5746) |
| 174 | ARELVALLV | (SEQ ID NO: 5747) |
| 148 | AHSMMRNFF | (SEQ ID NO: 5748) |
| 133 | AFGHYSEHW | (SEQ ID NO: 5749) |
| 121 | ASFRVVSGG | (SEQ ID NO: 5750) |
| 115 | ADRPAFASF | (SEQ ID NO: 5751) |
| 106 | ALVQQGSAF | (SEQ ID NO: 5752) |
| 102 | AIHQALVQQ | (SEQ ID NO: 5753) |
| 78 | ARRYGDVFQ | (SEQ ID NO: 5754) |
| 75 | ARLARRYGD | (SEQ ID NO: 5755) |
| 65 | AVGQAAHLS | (SEQ ID NO: 5756) |
| 50 | APPGPFAWP | (SEQ ID NO: 5757) |
| 31 | ATVHVGQRL | (SEQ ID NO: 5758) |
| 56 | AWPLIGNAAA | (SEQ ID NO: 5759) |
| 296 | FILSAEKKA | (SEQ ID NO: 5760) |
| 279 | HCESLRPGAA | (SEQ ID NO: 5761) |
| 139 | EHWKVQRRAA | (SEQ ID NO: 5762) |
| 61 | GNAAAVGQAA | (SEQ ID NO: 5763) |
| 55 | FAWPLIGNAA | (SEQ ID NO: 5764) |
| 193 | PRPLTVVAVA | (SEQ ID NO: 5765) |
| 112 | SAFADRPAFA | (SEQ ID NO: 5766) |
| 106 | ALVQQGSAFA | (SEQ ID NO: 5767) |
| 297 | ILSAEKKAAG | (SEQ ID NO: 5768) |
| 490 | QCDFRANPN | (SEQ ID NO: 5769) |
| 442 | PARFLDKDG | (SEQ ID NO: 5770) |

-continued

| | | |
|---|---|---|
| 433 | KWPNPENFD | (SEQ ID NO: 5771) |
| 425 | WSVNHDPLK | (SEQ ID NO: 5772) |
| 423 | NQWSVNHDP | (SEQ ID NO: 5773) |
| 401 | HATTANTSV | (SEQ ID NO: 5774) |
| 400 | PHATTANTS | (SEQ ID NO: 5775) |
| 395 | VPVTIPHAT | (SEQ ID NO: 5776) |
| 391 | FSSFVPVTI | (SEQ ID NO: 5777) |
| 388 | AMRFSSFVP | (SEQ ID NO: 5778) |
| 385 | LYEAMRFSS | (SEQ ID NO: 5779) |
| 369 | LPCMGDQPN | (SEQ ID NO: 5780) |
| 357 | QAELDQVVG | (SEQ ID NO: 5781) |
| 354 | TRVQAELDQ | (SEQ ID NO: 5782) |
| 306 | GDSHGGGAR | (SEQ ID NO: 5783) |
| 280 | CESLRPGAA | (SEQ ID NO: 5784) |
| 277 | LRHCESLRP | (SEQ ID NO: 5785) |
| 258 | FREFEQLNR | (SEQ ID NO: 5786) |
| 247 | LQYFPNPVR | (SEQ ID NO: 5787) |
| 225 | LSHNEEFGA | (SEQ ID NO: 5788) |
| 214 | YSHDDPEFR | (SEQ ID NO: 5789) |
| 212 | CRYSHDDPE | (SEQ ID NO: 5790) |
| 211 | GCRYSHDDP | (SEQ ID NO: 5791) |
| 204 | VMSAVCFGC | (SEQ ID NO: 5792) |
| 201 | VANVMSAVC | (SEQ ID NO: 5793) |
| 178 | VALLVRGSA | (SEQ ID NO: 5794) |
| 152 | MRNFFTRQP | (SEQ ID NO: 5795) |
| 134 | FGHYSEHWK | (SEQ ID NO: 5796) |
| 111 | GSAFADRPA | (SEQ ID NO: 5797) |
| 110 | QGSAFADRP | (SEQ ID NO: 5798) |
| 78 | ARRYGDVFQ | (SEQ ID NO: 5799) |
| 75 | ARLARRYGD | (SEQ ID NO: 5800) |
| 70 | AHLSFARLA | (SEQ ID NO: 5801) |
| 44 | RRQLRSAPP | (SEQ ID NO: 5802) |
| 41 | RQRRRQLRS | (SEQ ID NO: 5803) |
| 40 | LRQRRRQLR | (SEQ ID NO: 5804) |
| 37 | QRLLRQRRR | (SEQ ID NO: 5805) |
| 3 | TSLSPNDPW | (SEQ ID NO: 5806) |
| 333 | DTLSTALQWL | (SEQ ID NO: 5807) |
| 527 | ELLDSAVQNL | (SEQ ID NO: 5808) |
| 474 | ELSKMQLFLF | (SEQ ID NO: 5809) |
| 326 | DIFGASQDTL | (SEQ ID NO: 5810) |
| 403 | TTANTSVLGY | (SEQ ID NO: 5811) |
| 351 | DVQTRVQAEL | (SEQ ID NO: 5812) |
| 125 | VVSGGRSMAF | (SEQ ID NO: 5813) |
| 83 | DVFQIRLGSC | (SEQ ID NO: 5814) |
| 380 | YVLAFLYEAM | (SEQ ID NO: 5815) |
| 363 | VVGRDRLPCM | (SEQ ID NO: 5816) |
| 336 | STALQWLLLL | (SEQ ID NO: 5817) |
| 255 | RTVFREFEQL | (SEQ ID NO: 5818) |
| 181 | LVRGSADGAF | (SEQ ID NO: 5819) |
| 21 | TTLLLLLSVL | (SEQ ID NO: 5820) |
| 53 | GPFAWPLIG | (SEQ ID NO: 5821) |
| 50 | APPGPFAWP | (SEQ ID NO: 5822) |
| 46 | QLRSAPPGP | (SEQ ID NO: 5823) |
| 42 | QRRRQLRSA | (SEQ ID NO: 5824) |
| 41 | RQRRRQLRS | (SEQ ID NO: 5825) |
| 35 | VGQRLLRQR | (SEQ ID NO: 5826) |
| 30 | LATVHVGQR | (SEQ ID NO: 5827) |
| 27 | LSVLATVHV | (SEQ ID NO: 5828) |
| 24 | LLLLSVLAT | (SEQ ID NO: 5829) |
| 23 | LLLLLSVLA | (SEQ ID NO: 5830) |
| 12 | PLNPLSIQQ | (SEQ ID NO: 5831) |
| 10 | PWPLNPLSI | (SEQ ID NO: 5832) |
| 3 | TSLSPNDPW | (SEQ ID NO: 5833) |
| 533 | VQNLQAKET | (SEQ ID NO: 5834) |
| 529 | LDSAVQNLQ | (SEQ ID NO: 5835) |
| 523 | RESMELLDS | (SEQ ID NO: 5836) |
| 522 | LRESMELLD | (SEQ ID NO: 5837) |
| 506 | SYGLTIKPK | (SEQ ID NO: 5838) |
| 505 | FSYGLTLKP | (SEQ ID NO: 5839) |
| 503 | MNFSYGLTI | (SEQ ID NO: 5840) |
| 500 | PAKMNFSYG | (SEQ ID NO: 5841) |
| 498 | NEPAKMNFS | (SEQ ID NO: 5842) |
| 491 | CDFRANPNE | (SEQ ID NO: 5843) |
| 483 | FLSLLAHQC | (SEQ ID NO: 5844) |
| 476 | SKMQLFLFI | (SEQ ID NO: 5845) |
| 469 | RCIGEELSK | (SEQ ID NO: 5846) |
| 468 | RRCIGEELS | (SEQ ID NO: 5847) |
| 460 | VMIFSVGKR | (SEQ ID NO: 5848) |
| 451 | LINKDLTSR | (SEQ ID NO: 5849) |

-continued

| | | |
|---|---|---|
| 445 | FLDKDGLIN | (SEQ ID NO: 5850) |
| 444 | RFLDKDGLI | (SEQ ID NO: 5851) |
| 441 | DPARFLDKD | (SEQ ID NO: 5852) |
| 433 | KWPNPENFD | (SEQ ID NO: 5853) |
| 429 | HDPLKWPNP | (SEQ ID NO: 5854) |
| 426 | SVNHDPLKW | (SEQ ID NO: 5855) |
| 425 | WSVNHDPLK | (SEQ ID NO: 5856) |
| 422 | VNQWSVNHD | (SEQ ID NO: 5857) |
| 418 | TVVFVNQWS | (SEQ ID NO: 5858) |
| 410 | LGYHIPKDT | (SEQ ID NO: 5859) |
| 408 | SVLGYHIPK | (SEQ ID NO: 5860) |
| 387 | EAMRFSSFV | (SEQ ID NO: 5861) |
| 378 | LPYVLAFLY | (SEQ ID NO: 5862) |
| 369 | LPCMGDQPN | (SEQ ID NO: 5863) |
| 366 | RDRLPCMGD | (SEQ ID NO: 5864) |
| 363 | VVGRDRLPC | (SEQ ID NO: 5865) |
| 353 | QTRVQAELD | (SEQ ID NO: 5866) |
| 344 | LLFTRYPDV | (SEQ ID NO: 5867) |
| 343 | LLLFTRYPD | (SEQ ID NO: 5868) |
| 340 | QWLLLLFTR | (SEQ ID NO: 5869) |
| 328 | FGASQDTLS | (SEQ ID NO: 5870) |
| 326 | DIFGASQDT | (SEQ ID NO: 5871) |
| 322 | ATLTDLFGA | (SEQ ID NO: 5872) |
| 319 | NVPATLTDI | (SEQ ID NO: 5873) |
| 312 | GARLDLENV | (SEQ ID NO: 5874) |
| 310 | GGGARLDLE | (SEQ ID NO: 5875) |
| 304 | AAGDSHGGG | (SEQ ID NO: 5876) |
| 295 | AFILSAEKK | (SEQ ID NO: 5877) |
| 293 | MDAFILSAE | (SEQ ID NO: 5878) |
| 292 | MMDAFILSA | (SEQ ID NO: 5879) |
| 279 | HCESLRPGA | (SEQ ID NO: 5880) |
| 270 | NFILDKFLR | (SEQ ID NO: 5881) |
| 267 | NFSNFILDK | (SEQ ID NO: 5882) |
| 258 | FREFEQLNR | (SEQ ID NO: 5883) |
| 249 | YFPNPVRTV | (SEQ ID NO: 5884) |
| 248 | QYFPNPVRT | (SEQ ID NO: 5885) |
| 247 | LQYFPNPVR | (SEQ ID NO: 5886) |
| 243 | VMPWLQYFP | (SEQ ID NO: 5887) |
| 241 | VDVMPWLQY | (SEQ ID NO: 5888) |
| 240 | LVDVMPWLQ | (SEQ ID NO: 5889) |
| 210 | FGCRYSHDD | (SEQ ID NO: 5890) |
| 208 | VCFGCRYSH | (SEQ ID NO: 5891) |
| 205 | MSAVCFGCR | (SEQ ID NO: 5892) |
| 204 | VMSAVCFGC | (SEQ ID NO: 5893) |
| 203 | NVMSAVCFG | (SEQ ID NO: 5894) |
| 200 | AVANVMSAV | (SEQ ID NO: 5895) |
| 184 | GSADGAFLD | (SEQ ID NO: 5896) |
| 175 | RELVALLVR | (SEQ ID NO: 5897) |
| 174 | ARELVALLV | (SEQ ID NO: 5898) |
| 166 | LEGHVLSEA | (SEQ ID NO: 5899) |
| 155 | FFTRQPRSR | (SEQ ID NO: 5900) |
| 137 | YSEHWKVQR | (SEQ ID NO: 5901) |
| 135 | GHYSEHWKV | (SEQ ID NO: 5902) |
| 129 | GRSMAFGHY | (SEQ ID NO: 5903) |
| 125 | VVSGGRSMA | (SEQ ID NO: 5904) |
| 121 | ASFRVVSGG | (SEQ ID NO: 5905) |
| 119 | AFASFRVVS | (SEQ ID NO: 5906) |
| 111 | GSAFADRPA | (SEQ ID NO: 5907) |
| 98 | NGERAIHQA | (SEQ ID NO: 5908) |
| 87 | IRLGSCPIV | (SEQ ID NO: 5909) |
| 85 | FQIRLGSCP | (SEQ ID NO: 5910) |
| 67 | GQAAHLSFA | (SEQ ID NO: 5911) |
| 35 | VGQRLLRQR | (SEQ ID NO: 5912) |
| 33 | VHVGQRLLR | (SEQ ID NO: 5913) |
| 21 | TTLLLLLSV | (SEQ ID NO: 5914) |
| 20 | QTTLLLLLS | (SEQ ID NO: 5915) |
| 3 | TSLSPNDPW | (SEQ ID NO: 5916) |
| 280 | CESLRPGAAP | (SEQ ID NO: 5917) |
| 140 | HWKVQRRAAH | (SEQ ID NO: 5918) |
| 62 | NAAAVGQAAH | (SEQ ID NO: 5919) |
| 57 | WPLIGNAAAV | (SEQ ID NO: 5920) |
| 529 | LDSAVQNLQA | (SEQ ID NO: 5921) |
| 523 | RESMELLDSA | (SEQ ID NO: 5922) |
| 492 | DFRANPNEPA | (SEQ ID NO: 5923) |
| 486 | ILAHQCDFRA | (SEQ ID NO: 5924) |
| 479 | QLFLFISILA | (SEQ ID NO: 5925) |
| 434 | WPNPENFDPA | (SEQ ID NO: 5926) |
| 396 | PVTIPHATTA | (SEQ ID NO: 5927) |
| 393 | SFVPVTIPHA | (SEQ ID NO: 5928) |
| 379 | PYVLAFLYEA | (SEQ ID NO: 5929) |
| 374 | DQPNLPYVLA | (SEQ ID NO: 5930) |
| 349 | YPDVQTRVQA | (SEQ ID NO: 5931) |
| 329 | GASQDTLSTA | (SEQ ID NO: 5932) |
| 321 | PATITDIFGA | (SEQ ID NO: 5933) |
| 313 | ARLDLENVPA | (SEQ ID NO: 5934) |
| 304 | AAGDSHGGGA | (SEQ ID NO: 5935) |
| 295 | AFILSAEKKA | (SEQ ID NO: 5936) |
| 291 | DMMDAFILSA | (SEQ ID NO: 5937) |
| 286 | GAAPRDMMDA | (SEQ ID NO: 5938) |
| 278 | RHCESLRPGA | (SEQ ID NO: 5939) |
| 228 | NEEFGRTVGA | (SEQ ID NO: 5940) |
| 198 | VVAVANVMSA | (SEQ ID NO: 5941) |
| 191 | LDPRPLTVVA | (SEQ ID NO: 5942) |
| 180 | LLVRGSADGA | (SEQ ID NO: 5943) |
| 177 | LVALLVRGSA | (SEQ ID NO: 5944) |
| 170 | VLSEARELVA | (SEQ ID NO: 5945) |
| 165 | VLEGHVLSEA | (SEQ ID NO: 5946) |
| 138 | SEHWKVQRRA | (SEQ ID NO: 5947) |
| 124 | RVVSGGRSMA | (SEQ ID NO: 5948) |
| 110 | QGSAFADRPA | (SEQ ID NO: 5949) |
| 104 | HQALVQQGSA | (SEQ ID NO: 5950) |
| 97 | LNGERAIHQA | (SEQ ID NO: 5951) |
| 93 | PIVVLNGERA | (SEQ ID NO: 5952) |
| 69 | AAHLSFARLA | (SEQ ID NO: 5953) |
| 66 | VGQAAHLSFA | (SEQ ID NO: 5954) |
| 60 | IGNAAAVGQA | (SEQ ID NO: 5955) |
| 54 | PFAWPLIGNA | (SEQ ID NO: 5956) |
| 47 | LRSAPPGPFA | (SEQ ID NO: 5957) |
| 41 | RQRRRQLRSA | (SEQ ID NO: 5958) |
| 22 | TLLLLLSVLA | (SEQ ID NO: 5959) |
| 530 | DSAVQNLQAK | (SEQ ID NO: 5960) |
| 524 | ESMELLDSAV | (SEQ ID NO: 5961) |
| 493 | FRANPNEPAK | (SEQ ID NO: 5962) |
| 487 | LAHQCDFRAN | (SEQ ID NO: 5963) |
| 480 | LFLFISILAH | (SEQ ID NO: 5964) |
| 17 | SIQQTTLLLL | (SEQ ID NO: 5965) |
| 520 | VTLRESMELL | (SEQ ID NO: 5966) |
| 262 | EQLNRNFSNF | (SEQ ID NO: 5967) |
| 240 | LVDVMPWLQY | (SEQ ID NO: 5968) |
| 88 | RLGSCPIVVL | (SEQ ID NO: 5969) |
| 65 | AVGQAAHLSF | (SEQ ID NO: 5970) |
| 319 | NVPATITDIF | (SEQ ID NO: 5971) |
| 267 | NFSNFILDKF | (SEQ ID NO: 5972) |
| 519 | NVTLRESMEL | (SEQ ID NO: 5973) |
| 431 | PLKWPNPENF | (SEQ ID NO: 5974) |
| 517 | KVNVTLRESM | (SEQ ID NO: 5975) |
| 455 | DLTSRVMIFS | (SEQ ID NO: 5976) |
| 377 | NLPYVLAFLY | (SEQ ID NO: 5977) |
| 176 | ELVALLVRGS | (SEQ ID NO: 5978) |
| 142 | KVQRRAAHSM | (SEQ ID NO: 5979) |
| 76 | RLARRYGDVF | (SEQ ID NO: 5980) |
| 46 | QLRSAPPGPF | (SEQ ID NO: 5981) |
| 469 | RCIGEELSKM | (SEQ ID NO: 5982) |
| 408 | SVLGYHIPKD | (SEQ ID NO: 5983) |
| 242 | DVMPWLQYFP | (SEQ ID NO: 5984) |
| 196 | LTVVAVANVM | (SEQ ID NO: 5985) |
| 31 | ATVHVGQRLL | (SEQ ID NO: 5986) |
| 4 | SLSPNDPWPL | (SEQ ID NO: 5987) |
| 510 | TIKPKSFKVN | (SEQ ID NO: 5988) |
| 447 | DKDGLINKDL | (SEQ ID NO: 5989) |
| 417 | DTVVFVNQWS | (SEQ ID NO: 5990) |
| 413 | HIPKDTVVFV | (SEQ ID NO: 5991) |
| 322 | ATITDIFGAS | (SEQ ID NO: 5992) |
| 274 | DKFLRHCESL | (SEQ ID NO: 5993) |
| 249 | YFPNPVRTVF | (SEQ ID NO: 5994) |
| 198 | VVAVANVMSA | (SEQ ID NO: 5995) |
| 164 | QVLEGHVLSE | (SEQ ID NO: 5996) |
| 114 | FADRPAFASF | (SEQ ID NO: 5997) |
| 102 | AIHQALVQQG | (SEQ ID NO: 5998) |
| 38 | RLLRQRRRQL | (SEQ ID NO: 5999) |
| 481 | FLFISILAHQ | (SEQ ID NO: 6000) |
| 421 | FVNQWSVNHD | (SEQ ID NO: 6001) |
| 385 | LYEAMRFSSF | (SEQ ID NO: 6002) |
| 359 | ELDQVVGRDR | (SEQ ID NO: 6003) |
| 334 | TLSTALQWLL | (SEQ ID NO: 6004) |
| 287 | AAPRDMMDAF | (SEQ ID NO: 6005) |
| 271 | FILDKFLRHC | (SEQ ID NO: 6006) |
| 165 | VLEGHVLSEA | (SEQ ID NO: 6007) |

-continued

| | | |
|---|---|---|
| 146 | RAAHSMMPNF | (SEQ ID NO: 6008) |
| 128 | GGRSMAFGHY | (SEQ ID NO: 6009) |
| 34 | HVGQRLLRQR | (SEQ ID NO: 6010) |
| 15 | PLSIQQTTLL | (SEQ ID NO: 6011) |
| 12 | PLNPLSIQQT | (SEQ ID NO: 6012) |
| 301 | EKKAAGDSH | (SEQ ID NO: 6013) |
| 300 | AEKKAAGDS | (SEQ ID NO: 6014) |
| 294 | DAFILSAEK | (SEQ ID NO: 6015) |
| 292 | MMDAFILSA | (SEQ ID NO: 6016) |
| 291 | DMMDAFILS | (SEQ ID NO: 6017) |
| 287 | AAPRDMMDA | (SEQ ID NO: 6018) |
| 274 | DKFLRHCES | (SEQ ID NO: 6019) |
| 273 | LDKFLRHCE | (SEQ ID NO: 6020) |
| 270 | NFILDKFLR | (SEQ ID NO: 6021) |
| 266 | RNFSNFILD | (SEQ ID NO: 6022) |
| 262 | EQLNRNFSN | (SEQ ID NO: 6023) |
| 258 | FREFEQLNR | (SEQ ID NO: 6024) |
| 257 | VFREFEQLN | (SEQ ID NO: 6025) |
| 255 | RTVFREFEQ | (SEQ ID NO: 6026) |
| 246 | WLQYFPNPV | (SEQ ID NO: 6027) |
| 241 | VDVMPWLQY | (SEQ ID NO: 6028) |
| 233 | RTVGAGSLV | (SEQ ID NO: 6029) |
| 222 | RELLSHNEE | (SEQ ID NO: 6030) |
| 221 | FRELLSHNE | (SEQ ID NO: 6031) |
| 218 | DPEFRELLS | (SEQ ID NO: 6032) |
| 211 | GCRYSHDDP | (SEQ ID NO: 6033) |
| 204 | VMSAVCFGC | (SEQ ID NO: 6034) |
| 203 | NVMSAVCFG | (SEQ ID NO: 6035) |
| 185 | SADGAFLDP | (SEQ ID NO: 6036) |
| 181 | LVRGSADGA | (SEQ ID NO: 6037) |
| 180 | LLVRGSADG | (SEQ ID NO: 6038) |
| 178 | VALLVRGSA | (SEQ ID NO: 6039) |
| 174 | ARELVALLV | (SEQ ID NO: 6040) |
| 166 | LEGHVLSEA | (SEQ ID NO: 6041) |
| 162 | SRQVLEGHV | (SEQ ID NO: 6042) |
| 161 | RSRQVLEGH | (SEQ ID NO: 6043) |
| 153 | RNFFTRQPR | (SEQ ID NO: 6044) |
| 145 | RRAAHSMMR | (SEQ ID NO: 6045) |
| 128 | GGRSMAFGH | (SEQ ID NO: 6046) |
| 127 | SGGRSMAFG | (SEQ ID NO: 6047) |
| 122 | SFRVVSGGR | (SEQ ID NO: 6048) |
| 121 | ASFRVVSGG | (SEQ ID NO: 6049) |
| 105 | QALVQQGSA | (SEQ ID NO: 6050) |
| 104 | HQALVQQGS | (SEQ ID NO: 6051) |
| 97 | LNGERAIHQ | (SEQ ID NO: 6052) |
| 92 | CPLVVLNGE | (SEQ ID NO: 6053) |
| 91 | SCPIVVLNG | (SEQ ID NO: 6054) |
| 86 | QIRLGSCPI | (SEQ ID NO: 6055) |
| 80 | RYGDVFQIR | (SEQ ID NO: 6056) |
| 76 | RLARRYGDV | (SEQ ID NO: 6057) |
| 75 | ARLARRYGD | (SEQ ID NO: 6058) |
| 65 | AVGQAAHLS | (SEQ ID NO: 6059) |
| 56 | AWPLIGNAA | (SEQ ID NO: 6060) |
| 435 | PNPENFDPAR | (SEQ ID NO: 6061) |
| 397 | VTIPHATTAN | (SEQ ID NO: 6062) |
| 394 | FVPVTIPHAT | (SEQ ID NO: 6063) |
| 380 | YVLAFLYEAM | (SEQ ID NO: 6064) |
| 375 | QPNLPYVLAF | (SEQ ID NO: 6065) |
| 350 | PDVQTRVQAE | (SEQ ID NO: 6066) |
| 330 | ASQDTLSTAL | (SEQ ID NO: 6067) |
| 322 | ATITDIFGAS | (SEQ ID NO: 6068) |
| 314 | RLDLENVPAT | (SEQ ID NO: 6069) |
| 305 | AGDSHGGGAR | (SEQ ID NO: 6070) |
| 292 | MMDAFILSAE | (SEQ ID NO: 6071) |
| 287 | AAPRDMMDAF | (SEQ ID NO: 6072) |
| 229 | EEFGRTVGAG | (SEQ ID NO: 6073) |
| 199 | VAVANVMSAV | (SEQ ID NO: 6074) |
| 194 | RPLTVVAVAN | (SEQ ID NO: 6075) |
| 192 | DPRPLTVVAV | (SEQ ID NO: 6076) |
| 181 | LVRGSADGAF | (SEQ ID NO: 6077) |
| 178 | VALLVRGSAD | (SEQ ID NO: 6078) |
| 171 | LSEARELVAL | (SEQ ID NO: 6079) |
| 166 | LEGHVLSEAR | (SEQ ID NO: 6080) |
| 125 | VVSGGRSMAF | (SEQ ID NO: 6081) |
| 113 | AFADRPAFAS | (SEQ ID NO: 6082) |
| 111 | GSAFADRPAF | (SEQ ID NO: 6083) |
| 107 | LVQQGSAFAD | (SEQ ID NO: 6084) |
| 105 | QALVQQGSAF | (SEQ ID NO: 6085) |
| 98 | NGERAIHQAL | (SEQ ID NO: 6086) |
| 94 | IVVLNGERAI | (SEQ ID NO: 6087) |
| 70 | AHLSFARLAR | (SEQ ID NO: 6088) |
| 67 | GQAAHLSFAR | (SEQ ID NO: 6089) |
| 48 | RSAPPGPFAW | (SEQ ID NO: 6090) |
| 42 | QRRRQLRSAP | (SEQ ID NO: 6091) |
| 23 | LLLLLSVLAT | (SEQ ID NO: 6092) |
| 531 | SAVQNLQAKE | (SEQ ID NO: 6093) |
| 525 | SMELLDSAVQ | (SEQ ID NO: 6094) |
| 494 | RANPNEPAKM | (SEQ ID NO: 6095) |
| 488 | AHQCDFRANP | (SEQ ID NO: 6096) |
| 481 | FLFISILAHQ | (SEQ ID NO: 6097) |
| 436 | NPENFDPARF | (SEQ ID NO: 6098) |
| 398 | TIPHATTANT | (SEQ ID NO: 6099) |
| 395 | VPVTIPHATT | (SEQ ID NO: 6100) |
| 381 | VLAFLYEAMR | (SEQ ID NO: 6101) |
| 376 | PNLPYVLAFL | (SEQ ID NO: 6102) |
| 351 | DVQTRVQAEL | (SEQ ID NO: 6103) |
| 331 | SQDTLSTALQ | (SEQ ID NO: 6104) |
| 323 | TLTDLFGASQ | (SEQ ID NO: 6105) |
| 315 | LDLENVPATI | (SEQ ID NO: 6106) |
| 306 | GDSHGGGARL | (SEQ ID NO: 6107) |
| 298 | LSAEKKAAGD | (SEQ ID NO: 6108) |
| 293 | MDAFILSAEK | (SEQ ID NO: 6109) |
| 288 | APRDMMDAFI | (SEQ ID NO: 6110) |
| 281 | ESLRPGAAPR | (SEQ ID NO: 6111) |
| 230 | EFGRTVGAGS | (SEQ ID NO: 6112) |
| 200 | AVANVMSAVC | (SEQ ID NO: 6113) |
| 195 | PLTVVAVANV | (SEQ ID NO: 6114) |
| 473 | EELSKMQLFL | (SEQ ID NO: 6115) |
| 472 | GEELSKMQLF | (SEQ ID NO: 6116) |
| 459 | RVMIFSVGKR | (SEQ ID NO: 6117) |
| 456 | LTSRVMIFSV | (SEQ ID NO: 6118) |
| 454 | KDLTSRVMIF | (SEQ ID NO: 6119) |
| 450 | GLINKDLTSR | (SEQ ID NO: 6120) |
| 445 | FLDKDGLINK | (SEQ ID NO: 6121) |
| 412 | YHIPKDTVVF | (SEQ ID NO: 6122) |
| 397 | VTIPHATTAN | (SEQ ID NO: 6123) |
| 376 | PNLPYVLAFL | (SEQ ID NO: 6124) |
| 375 | QPNLPYVLAF | (SEQ ID NO: 6125) |
| 346 | FTRYPDVQTR | (SEQ ID NO: 6126) |
| 340 | QWLLLLFTRY | (SEQ ID NO: 6127) |
| 337 | TALQWLLLLF | (SEQ ID NO: 6128) |
| 314 | RLDLENVPAT | (SEQ ID NO: 6129) |
| 259 | REFEQLRNF | (SEQ ID NO: 6130) |
| 252 | NPVRTVFREF | (SEQ ID NO: 6131) |
| 241 | VDVMPWLQYF | (SEQ ID NO: 6132) |
| 235 | VGAGSLVDVM | (SEQ ID NO: 6133) |
| 234 | TVGAGSLVDV | (SEQ ID NO: 6134) |
| 229 | EEFGRTVGAG | (SEQ ID NO: 6135) |
| 223 | ELLSHNEEFG | (SEQ ID NO: 6136) |
| 220 | EFRELLSHNE | (SEQ ID NO: 6137) |
| 215 | SHDDPEFREL | (SEQ ID NO: 6138) |
| 190 | FLDPRPLTVV | (SEQ ID NO: 6139) |
| 187 | DGAFLDPRPL | (SEQ ID NO: 6140) |
| 68 | QAAHLSFARL | (SEQ ID NO: 6141) |
| 20 | QTTLLLLLSV | (SEQ ID NO: 6142) |
| 7 | PNDPWPLNPL | (SEQ ID NO: 6143) |
| 509 | LTIKPKSFKV | (SEQ ID NO: 6144) |
| 496 | NPNEPAKMNF | (SEQ ID NO: 6145) |
| 461 | MIFSVGKRRC | (SEQ ID NO: 6146) |
| 426 | SVNHDPLKWP | (SEQ ID NO: 6147) |
| 406 | NTSVLGYHIP | (SEQ ID NO: 6148) |
| 393 | SFVPVTIPHA | (SEQ ID NO: 6149) |
| 382 | LAFLYEAMRF | (SEQ ID NO: 6150) |
| 316 | DLENVPATIT | (SEQ ID NO: 6151) |
| 230 | EFGRTVGAGS | (SEQ ID NO: 6152) |
| 195 | PLTVVAVANV | (SEQ ID NO: 6153) |
| 192 | DPRPLTVVAV | (SEQ ID NO: 6154) |
| 172 | SEARELVALL | (SEQ ID NO: 6155) |
| 171 | LSEARELVAL | (SEQ ID NO: 6156) |
| 119 | AFASFRVVSG | (SEQ ID NO: 6157) |
| 71 | HLSFARLARR | (SEQ ID NO: 6158) |
| 29 | VLATVHVGQR | (SEQ ID NO: 6159) |
| 530 | DSAVQNLQAK | (SEQ ID NO: 6160) |
| 499 | EPAKMNFSYG | (SEQ ID NO: 6161) |
| 478 | MQLFLFLSLL | (SEQ ID NO: 6162) |
| 470 | CIGEELSKMQ | (SEQ ID NO: 6163) |
| 451 | LINKDLTSRV | (SEQ ID NO: 6164) |
| 439 | NFDPARFLDK | (SEQ ID NO: 6165) |

-continued

| | | |
|---|---|---|
| 419 | VVFVNQWSVN | (SEQ ID NO: 6166) |
| 398 | TLPHATTANT | (SEQ ID NO: 6167) |
| 343 | LLLFTRYPDV | (SEQ ID NO: 6168) |
| 52 | PGPFAWPLI | (SEQ ID NO: 6169) |
| 45 | RQLRSAPPG | (SEQ ID NO: 6170) |
| 40 | LRQRRRQLR | (SEQ ID NO: 6171) |
| 25 | LLLSVLATV | (SEQ ID NO: 6172) |
| 21 | TTLLLLLSV | (SEQ ID NO: 6173) |
| 14 | NPLSIQQTT | (SEQ ID NO: 6174) |
| 13 | LNPLSIQQT | (SEQ ID NO: 6175) |
| 11 | WPLNPLSIQ | (SEQ ID NO: 6176) |
| 1 | MGTSLSPND | (SEQ ID NO: 6177) |
| 182 | VRGSADGAFL | (SEQ ID NO: 6178) |
| 179 | ALLVRGSADG | (SEQ ID NO: 6179) |
| 172 | SEARELVALL | (SEQ ID NO: 6180) |
| 167 | EGHVLSEARE | (SEQ ID NO: 6181) |
| 141 | WKVQRRAAHS | (SEQ ID NO: 6182) |
| 126 | VSGGRSMAFG | (SEQ ID NO: 6183) |
| 114 | FADRPAFASF | (SEQ ID NO: 6184) |
| 108 | VQQGSAFADR | (SEQ ID NO: 6185) |
| 99 | GERAIHQALV | (SEQ ID NO: 6186) |
| 95 | VVLNGERAIH | (SEQ ID NO: 6187) |
| 71 | HLSFARLARR | (SEQ ID NO: 6188) |
| 68 | QAAHLSFARL | (SEQ ID NO: 6189) |
| 63 | AAAVGQAAHL | (SEQ ID NO: 6190) |
| 58 | PLIGNAAAVG | (SEQ ID NO: 6191) |
| 49 | SAPPGPFAWP | (SEQ ID NO: 6192) |
| 43 | RRRQLRSAPP | (SEQ ID NO: 6193) |
| 24 | LLLLSVLATV | (SEQ ID NO: 6194) |
| 531 | SAVQNLQA | (SEQ ID NO: 6195) |
| 525 | SMELLDSA | (SEQ ID NO: 6196) |
| 494 | RANPNEPA | (SEQ ID NO: 6197) |
| 488 | AHQCDFRA | (SEQ ID NO: 6198) |
| 481 | FLFLSLLA | (SEQ ID NO: 6199) |
| 436 | NPENFDPA | (SEQ ID NO: 6200) |
| 398 | TIPHATTA | (SEQ ID NO: 6201) |
| 395 | VPVTIPHA | (SEQ ID NO: 6202) |
| 381 | VLAFLYEA | (SEQ ID NO: 6203) |
| 376 | PNLPYVLA | (SEQ ID NO: 6204) |
| 351 | DVQTRVQA | (SEQ ID NO: 6205) |
| 331 | SQDTLSTA | (SEQ ID NO: 6206) |
| 323 | TLTDLFGA | (SEQ ID NO: 6207) |
| 315 | LDLENVPA | (SEQ ID NO: 6208) |
| 306 | GDSHGGGA | (SEQ ID NO: 6209) |
| 298 | LSAEKKAA | (SEQ ID NO: 6210) |
| 297 | ILSAEKKA | (SEQ ID NO: 6211) |
| 293 | MDAFILSA | (SEQ ID NO: 6212) |
| 288 | APRDMMDA | (SEQ ID NO: 6213) |
| 281 | ESLRPGAA | (SEQ ID NO: 6214) |
| 280 | CESLRPGA | (SEQ ID NO: 6215) |
| 230 | EFGRTVGA | (SEQ ID NO: 6216) |
| 200 | AVANVMSA | (SEQ ID NO: 6217) |
| 195 | PLTVVAVA | (SEQ ID NO: 6218) |
| 193 | PRPLTVVA | (SEQ ID NO: 6219) |
| 182 | VRGSADGA | (SEQ ID NO: 6220) |
| 179 | ALLVRGSA | (SEQ ID NO: 6221) |
| 172 | SEARELVA | (SEQ ID NO: 6222) |
| 167 | EGHVLSEA | (SEQ ID NO: 6223) |
| 141 | WKVQRRAA | (SEQ ID NO: 6224) |
| 324 | ITDIFGASQD | (SEQ ID NO: 6225) |
| 323 | TLTDLFGASQ | (SEQ ID NO: 6226) |
| 270 | NFILDKFLRH | (SEQ ID NO: 6227) |
| 260 | EFEQLNRNFS | (SEQ ID NO: 6228) |
| 256 | TVFREFEQLN | (SEQ ID NO: 6229) |
| 238 | GSLVDVMPWL | (SEQ ID NO: 6230) |
| 212 | CRYSHDDPEF | (SEQ ID NO: 6231) |
| 124 | RVVSGGRSMA | (SEQ ID NO: 6232) |
| 111 | GSAFADRPAF | (SEQ ID NO: 6233) |
| 72 | LSFARLARRY | (SEQ ID NO: 6234) |
| 58 | PLIGNAAAVG | (SEQ ID NO: 6235) |
| 24 | LLLLSVLATV | (SEQ ID NO: 6236) |
| 23 | LLLLLSVLAT | (SEQ ID NO: 6237) |
| 498 | NEPAKMNFSY | (SEQ ID NO: 6238) |
| 494 | RANPNEPAKM | (SEQ ID NO: 6239) |
| 492 | DFRANPNEPA | (SEQ ID NO: 6240) |
| 484 | ISILAHQCDF | (SEQ ID NO: 6241) |
| 471 | IGEELSKMQL | (SEQ ID NO: 6242) |
| 464 | SVGKRRCIGE | (SEQ ID NO: 6243) |
| 436 | NPENFDPARF | (SEQ ID NO: 6244) |

-continued

| | | |
|---|---|---|
| 394 | FVPVTIPHAT | (SEQ ID NO: 6245) |
| 374 | DQPNLPYVLA | (SEQ ID NO: 6246) |
| 362 | QVVGRDRLPC | (SEQ ID NO: 6247) |
| 338 | ALQWLLLLFT | (SEQ ID NO: 6248) |
| 318 | ENVPATITDI | (SEQ ID NO: 6249) |
| 296 | FILSAEKKAA | (SEQ ID NO: 6250) |
| 291 | DMMDAFILSA | (SEQ ID NO: 6251) |
| 282 | SLRPGAAPRD | (SEQ ID NO: 6252) |
| 233 | RTVGAGSLVD | (SEQ ID NO: 6253) |
| 205 | MSAVCFGCRY | (SEQ ID NO: 6254) |
| 203 | NVMSAVCFGC | (SEQ ID NO: 6255) |
| 200 | AVANVMSAVC | (SEQ ID NO: 6256) |
| 197 | TVVAVANVMS | (SEQ ID NO: 6257) |
| 177 | LVALLVRGSA | (SEQ ID NO: 6258) |
| 156 | FTRQPRSRQV | (SEQ ID NO: 6259) |
| 107 | LVQQGSAFAD | (SEQ ID NO: 6260) |
| 105 | QALVQQGSAF | (SEQ ID NO: 6261) |
| 59 | LIGNAAAVGQ | (SEQ ID NO: 6262) |
| 54 | PFAWPLIGNA | (SEQ ID NO: 6263) |
| 28 | SVLATVHVGQ | (SEQ ID NO: 6264) |
| 18 | IQQTTLLLLL | (SEQ ID NO: 6265) |
| 532 | AVQNLQAKET | (SEQ ID NO: 6266) |
| 507 | YGLTIKPKSF | (SEQ ID NO: 6267) |
| 483 | FLSLLAHQCD | (SEQ ID NO: 6268) |
| 480 | LFLFLSLLAH | (SEQ ID NO: 6269) |
| 418 | TVVFVNQWSV | (SEQ ID NO: 6270) |
| 402 | ATTANTSVLG | (SEQ ID NO: 6271) |
| 384 | FLYEAMRFSS | (SEQ ID NO: 6272) |
| 381 | VLAFLYEAMR | (SEQ ID NO: 6273) |
| 371 | CMGDQPNLPY | (SEQ ID NO: 6274) |
| 355 | RVQAELDQVV | (SEQ ID NO: 6275) |
| 140 | HWKVQRRA | (SEQ ID NO: 6276) |
| 126 | VSGGRSMA | (SEQ ID NO: 6277) |
| 114 | FADRPAFA | (SEQ ID NO: 6278) |
| 112 | SAFADRPA | (SEQ ID NO: 6279) |
| 108 | VQQGSAFA | (SEQ ID NO: 6280) |
| 106 | ALVQQGSA | (SEQ ID NO: 6281) |
| 99 | GERAIHQA | (SEQ ID NO: 6282) |
| 95 | VVLNGERA | (SEQ ID NO: 6283) |
| 71 | HLSFARLA | (SEQ ID NO: 6284) |
| 68 | QAAHLSFA | (SEQ ID NO: 6285) |
| 63 | AAAVGQAA | (SEQ ID NO: 6286) |
| 62 | NAAAVGQA | (SEQ ID NO: 6287) |
| 58 | PLIGNAAA | (SEQ ID NO: 6288) |
| 57 | WPLIGNAA | (SEQ ID NO: 6289) |
| 56 | AWPLIGNA | (SEQ ID NO: 6290) |
| 49 | SAPPGPFA | (SEQ ID NO: 6291) |
| 43 | RRRQLRSA | (SEQ ID NO: 6292) |
| 24 | LLLLSVLA | (SEQ ID NO: 6293) |
| 283 | LRPGAAPRDM | (SEQ ID NO: 6294) |
| 222 | RELLSHNEEF | (SEQ ID NO: 6295) |
| 218 | DPEFRELLSH | (SEQ ID NO: 6296) |
| 216 | HDDPEFRELL | (SEQ ID NO: 6297) |
| 207 | AVCFGCRYSH | (SEQ ID NO: 6298) |
| 201 | VANVMSAVCF | (SEQ ID NO: 6299) |
| 169 | HVLSEARELV | (SEQ ID NO: 6300) |
| 157 | TRQPRSRQVL | (SEQ ID NO: 6301) |
| 147 | AAHSMMRNFF | (SEQ ID NO: 6302) |
| 96 | VLNGERAIHQ | (SEQ ID NO: 6303) |
| 95 | VVLNGERAIH | (SEQ ID NO: 6304) |
| 94 | IVVLNGERAI | (SEQ ID NO: 6305) |
| 93 | PIVVLNGERA | (SEQ ID NO: 6306) |
| 86 | QLRLGSCPLV | (SEQ ID NO: 6307) |
| 63 | AAAVGQAAHL | (SEQ ID NO: 6308) |
| 50 | APPGPFAWPL | (SEQ ID NO: 6309) |
| 16 | LSIQQTTLLL | (SEQ ID NO: 6310) |
| 528 | LLDSAVQNLQ | (SEQ ID NO: 6311) |
| 524 | ESMELLDSAV | (SEQ ID NO: 6312) |
| 521 | TLRESMELLD | (SEQ ID NO: 6313) |
| 500 | PAKMNFS-YGL | (SEQ ID NO: 6314) |
| 486 | ILAHQCDFRA | (SEQ ID NO: 6315) |
| 485 | SILAHQCDFR | (SEQ ID NO: 6316) |
| 482 | LFLSLLAHQC | (SEQ ID NO: 6317) |
| 479 | QLFLFISILA | (SEQ ID NO: 6318) |
| 452 | INKDLTSRVM | (SEQ ID NO: 6319) |
| 396 | PVTIPHATTA | (SEQ ID NO: 6320) |
| 383 | AFLYEAMRFS | (SEQ ID NO: 6321) |
| 373 | GDQPNLPYVL | (SEQ ID NO: 6322) |
| 369 | LPCMGDQPNL | (SEQ ID NO: 6323) |

| | | |
|---|---|---|
| 368 | RLPCMGDQPN | (SEQ ID NO: 6324) |
| 353 | QTRVQAELDQ | (SEQ ID NO: 6325) |
| 344 | LLFTRYPDVQ | (SEQ ID NO: 6326) |
| 330 | ASQDTLSTAL | (SEQ ID NO: 6327) |
| 308 | SHGGGARLDL | (SEQ ID NO: 6328) |
| 306 | GDSHGGGARL | (SEQ ID NO: 6329) |
| 297 | ILSAEKKAAG | (SEQ ID NO: 6330) |
| 272 | ILDKFLRHCE | (SEQ ID NO: 6331) |
| 253 | PVRTVFREFE | (SEQ ID NO: 6332) |
| 208 | VCFGCRYSHD | (SEQ ID NO: 6333) |
| 182 | VRGSADGAFL | (SEQ ID NO: 6334) |
| 170 | VLSEARELVA | (SEQ ID NO: 6335) |
| 143 | VQRRAAHSMM | (SEQ ID NO: 6336) |
| 106 | ALVQQGSAFA | (SEQ ID NO: 6337) |
| 98 | NGERAIHQAL | (SEQ ID NO: 6338) |
| 80 | RYGDVFQIRL | (SEQ ID NO: 6339) |
| 39 | LLRQRRRQLR | (SEQ ID NO: 6340) |
| 32 | TVHVGQRLLR | (SEQ ID NO: 6341) |
| 30 | LATVHVGQRL | (SEQ ID NO: 6342) |
| 26 | LLSVLATVHV | (SEQ ID NO: 6343) |
| 2 | GTSLSPNDPW | (SEQ ID NO: 6344) |
| 513 | PKSFKVNVTL | (SEQ ID NO: 6345) |
| 508 | GLTIKPKSFK | (SEQ ID NO: 6346) |
| 466 | GKRRCIGEEL | (SEQ ID NO: 6347) |
| 442 | PARFLDKDGL | (SEQ ID NO: 6348) |
| 438 | ENFDPARFLD | (SEQ ID NO: 6349) |
| 430 | DPLKWPNPEN | (SEQ ID NO: 6350) |
| 423 | NQWSVNHDPL | (SEQ ID NO: 6351) |
| 401 | HATTANTSVL | (SEQ ID NO: 6352) |
| 367 | DRLPCMGDQP | (SEQ ID NO: 6353) |
| 360 | LDQVVGRDRL | (SEQ ID NO: 6354) |
| 301 | EKKAAGDSHG | (SEQ ID NO: 6355) |
| 295 | AFILSAEKKA | (SEQ ID NO: 6356) |
| 294 | DAFILSAEKK | (SEQ ID NO: 6357) |
| 289 | PRDMMDAFIL | (SEQ ID NO: 6358) |
| 284 | RPGAAPRDMM | (SEQ ID NO: 6359) |
| 276 | FLRHCESLRP | (SEQ ID NO: 6360) |
| 257 | VFREFEQLNR | (SEQ ID NO: 6361) |
| 246 | WLQYFPNPVR | (SEQ ID NO: 6362) |
| 239 | SLVDVMPWLQ | (SEQ ID NO: 6363) |
| 231 | FGRTVGAGSL | (SEQ ID NO: 6364) |
| 224 | LLSHNEEFGR | (SEQ ID NO: 6365) |
| 217 | DDPEFRELLS | (SEQ ID NO: 6366) |
| 180 | LLVRGSADGA | (SEQ ID NO: 6367) |
| 179 | ALLVRGSADG | (SEQ ID NO: 6368) |
| 168 | GHVLSEAREL | (SEQ ID NO: 6369) |
| 154 | NFFTRQPRSR | (SEQ ID NO: 6370) |
| 123 | FRVVSGGRSM | (SEQ ID NO: 6371) |
| 113 | AFADRPAFAS | (SEQ ID NO: 6372) |
| 25 | LLLSVLATVH | (SEQ ID NO: 6373) |
| 22 | TLLLLLSVLA | (SEQ ID NO: 6374) |
| 14 | NPLSIQQTTL | (SEQ ID NO: 6375) |
| 9 | DPWPLNPLSI | (SEQ ID NO: 6376) |
| 515 | SFKVNVTLRE | (SEQ ID NO: 6377) |
| 437 | PENFDPARFL | (SEQ ID NO: 6378) |
| 420 | VFVNQWSVNH | (SEQ ID NO: 6379) |
| 409 | VLGYHIPKDT | (SEQ ID NO: 6380) |
| 390 | RFSSFVPVTI | (SEQ ID NO: 6381) |
| 389 | MRFSSFVPVT | (SEQ ID NO: 6382) |
| 345 | LFTRYPDVQT | (SEQ ID NO: 6383) |
| 342 | LLLLFTRYPD | (SEQ ID NO: 6384) |
| 341 | WLLLLFTRYP | (SEQ ID NO: 6385) |
| 335 | LSTALQWLLL | (SEQ ID NO: 6386) |
| 307 | DSHGGGARLD | (SEQ ID NO: 6387) |
| 286 | GAAPRDMMDA | (SEQ ID NO: 6388) |
| 268 | FSNFILDKFL | (SEQ ID NO: 6389) |
| 264 | LNRNFSNFLL | (SEQ ID NO: 6390) |
| 263 | QLNRNFSNFI | (SEQ ID NO: 6391) |
| 248 | QYFPNPVRTV | (SEQ ID NO: 6392) |
| 219 | PEFRELLSHN | (SEQ ID NO: 6393) |
| 173 | EARELVALLV | (SEQ ID NO: 6394) |
| 167 | EGHVLSEARE | (SEQ ID NO: 6395) |
| 162 | SRQVLEGHVL | (SEQ ID NO: 6396) |
| 155 | FFTRQPRSRQ | (SEQ ID NO: 6397) |
| 139 | EHWKVQRRAA | (SEQ ID NO: 6398) |
| 116 | DRPAFASFRV | (SEQ ID NO: 6399) |
| 101 | RAIHQALVQQ | (SEQ ID NO: 6400) |
| 49 | SAPPGPFAWP | (SEQ ID NO: 6401) |
| 514 | KSFKVNVTLR | (SEQ ID NO: 6402) |
| 504 | NFSYGLTIKP | (SEQ ID NO: 6403) |
| 503 | MNFSYGLTIK | (SEQ ID NO: 6404) |
| 446 | LDKDGLINKD | (SEQ ID NO: 6405) |
| 444 | RFLDKDGLIN | (SEQ ID NO: 6406) |
| 441 | DPARFLDKDG | (SEQ ID NO: 6407) |
| 415 | PKDTVVFVNQ | (SEQ ID NO: 6408) |
| 372 | MGDQPNLPYV | (SEQ ID NO: 6409) |
| 350 | PDVQTRVQAE | (SEQ ID NO: 6410) |
| 292 | MMDAFILSAE | (SEQ ID NO: 6411) |
| 281 | ESLRPGAAPR | (SEQ ID NO: 6412) |
| 275 | KFLRHCESLR | (SEQ ID NO: 6413) |
| 266 | RNFSNFILDK | (SEQ ID NO: 6414) |
| 189 | AFLDPRPLTV | (SEQ ID NO: 6415) |
| 185 | SADGAFLDPR | (SEQ ID NO: 6416) |
| 145 | RRAAHSMMRN | (SEQ ID NO: 6417) |
| 131 | SMAFGHYSEH | (SEQ ID NO: 6418) |
| 126 | VSGGRSMAFG | (SEQ ID NO: 6419) |
| 122 | SFRVVSGGRS | (SEQ ID NO: 6420) |
| 108 | VQQGSAFADR | (SEQ ID NO: 6421) |
| 100 | ERAIHQALVQ | (SEQ ID NO: 6422) |
| 97 | LNGERAIHQA | (SEQ ID NO: 6423) |
| 90 | GSCPIVVLNG | (SEQ ID NO: 6424) |
| 84 | VFQLRLGSCP | (SEQ ID NO: 6425) |
| 79 | RRYGDVFQIR | (SEQ ID NO: 6426) |
| 73 | SFARLARRYG | (SEQ ID NO: 6427) |
| 53 | GPFAWPLIGN | (SEQ ID NO: 6428) |
| 33 | VHVGQRLLRQ | (SEQ ID NO: 6429) |
| 512 | KPKSFKVNVT | (SEQ ID NO: 6430) |
| 505 | FSYGLTIKPK | (SEQ ID NO: 6431) |
| 497 | PNEPAKMNFS | (SEQ ID NO: 6432) |
| 487 | LAHQCDFRAN | (SEQ ID NO: 6433) |
| 465 | VGKRRCIGEE | (SEQ ID NO: 6434) |
| 462 | IFSVGKRRCI | (SEQ ID NO: 6435) |
| 449 | DGLINKDLTS | (SEQ ID NO: 6436) |
| 440 | FDPARFLDKD | (SEQ ID NO: 6437) |
| 434 | WPNPENFDPA | (SEQ ID NO: 6438) |
| 414 | IPKDTVVFVN | (SEQ ID NO: 6439) |
| 387 | EAMRFSSFVP | (SEQ ID NO: 6440) |
| 361 | DQVVGRDRLP | (SEQ ID NO: 6441) |
| 358 | AELDQVVGRD | (SEQ ID NO: 6442) |
| 357 | QAELDQVVGR | (SEQ ID NO: 6443) |
| 354 | TRVQAELDQV | (SEQ ID NO: 6444) |
| 329 | GASQDTLSTA | (SEQ ID NO: 6445) |
| 327 | IFGASQDTLS | (SEQ ID NO: 6446) |
| 311 | GGARLDLENV | (SEQ ID NO: 6447) |
| 309 | HGGGARLDLE | (SEQ ID NO: 6448) |
| 251 | PNPVRTVFRE | (SEQ ID NO: 6449) |
| 244 | MPWLQYFPNP | (SEQ ID NO: 6450) |
| 209 | CFGCRYSHDD | (SEQ ID NO: 6451) |
| 199 | VAVANVMSAV | (SEQ ID NO: 6452) |
| 193 | PRPLTVVAVA | (SEQ ID NO: 6453) |
| 184 | GSADGAFLDP | (SEQ ID NO: 6454) |
| 175 | RELVALLVRG | (SEQ ID NO: 6455) |
| 159 | QPRSRQVLEG | (SEQ ID NO: 6456) |
| 137 | YSEHWKVQRR | (SEQ ID NO: 6457) |
| 133 | AFGHYSEHWK | (SEQ ID NO: 6458) |
| 120 | FASFRVVSGG | (SEQ ID NO: 6459) |
| 91 | SCPIVVLNGE | (SEQ ID NO: 6460) |
| 10 | PWPLNPLSIQ | (SEQ ID NO: 6461) |
| 523 | RESMELLDSA | (SEQ ID NO: 6462) |
| 522 | LRESMELLDS | (SEQ ID NO: 6463) |
| 516 | FKVNVTLRES | (SEQ ID NO: 6464) |
| 477 | KMQLFLFLSI | (SEQ ID NO: 6465) |
| 476 | SKMQLFLFIS | (SEQ ID NO: 6466) |
| 475 | LSKMQLFLFI | (SEQ ID NO: 6467) |
| 457 | TSRVMIFSVG | (SEQ ID NO: 6468) |
| 435 | PNPENFDPAR | (SEQ ID NO: 6469) |
| 428 | NHDPLKWPNP | (SEQ ID NO: 6470) |
| 416 | KDTVVFVNQW | (SEQ ID NO: 6471) |
| 388 | AMRFSSFVPV | (SEQ ID NO: 6472) |
| 379 | PYVLAFLYEA | (SEQ ID NO: 6473) |
| 321 | PATITDIFGA | (SEQ ID NO: 6474) |
| 298 | LSAEKKAAGD | (SEQ ID NO: 6475) |
| 258 | FREFEQLNRN | (SEQ ID NO: 6476) |
| 243 | VMPWLQYFPN | (SEQ ID NO: 6477) |
| 237 | AGSLVDVMPW | (SEQ ID NO: 6478) |
| 225 | LSHNEEFGRT | (SEQ ID NO: 6479) |
| 160 | PRSRQVLEGH | (SEQ ID NO: 6480) |
| 150 | SMMRNFFTRQ | (SEQ ID NO: 6481) |

-continued

| | | |
|---|---|---|
| 132 | MAFGHYSEHW | (SEQ ID NO: 6482) |
| 117 | RPAFASFRVV | (SEQ ID NO: 6483) |
| 89 | LGSCPIVVLN | (SEQ ID NO: 6484) |
| 81 | YGDVFQIRLG | (SEQ ID NO: 6485) |
| 78 | ARRYGDVFQI | (SEQ ID NO: 6486) |
| 66 | VGQAAHLSFA | (SEQ ID NO: 6487) |
| 60 | IGNAAAVGQA | (SEQ ID NO: 6488) |
| 41 | RQRRRQLRSA | (SEQ ID NO: 6489) |
| 511 | IKPKSFKVNV | (SEQ ID NO: 6490) |
| 501 | AKMNFSYGLT | (SEQ ID NO: 6491) |
| 404 | TANTSVLGYH | (SEQ ID NO: 6492) |
| 391 | FSSFVPVTIP | (SEQ ID NO: 6493) |
| 378 | LPYVLAFLYE | (SEQ ID NO: 6494) |
| 366 | RDRLPCMGDQ | (SEQ ID NO: 6495) |
| 356 | VQAELDQVVG | (SEQ ID NO: 6496) |
| 339 | LQWLLLLFTR | (SEQ ID NO: 6497) |
| 303 | KAAGDSHGGG | (SEQ ID NO: 6498) |
| 290 | RDMMDAFILS | (SEQ ID NO: 6499) |
| 278 | RHCESLRPGA | (SEQ ID NO: 6500) |
| 277 | LRHCESLRPG | (SEQ ID NO: 6501) |
| 265 | NRNFSNFILD | (SEQ ID NO: 6502) |
| 204 | VMSAVCFGCR | (SEQ ID NO: 6503) |
| 202 | ANVMSAVCFG | (SEQ ID NO: 6504) |
| 174 | ARELVALLVR | (SEQ ID NO: 6505) |
| 153 | RNFFTRQPRS | (SEQ ID NO: 6506) |
| 149 | HSMMRNFFTR | (SEQ ID NO: 6507) |
| 136 | HYSEHWKVQR | (SEQ ID NO: 6508) |
| 75 | ARLARRYGDV | (SEQ ID NO: 6509) |
| 48 | RSAPPGPFAW | (SEQ ID NO: 6510) |
| 27 | LSVLATVHVG | (SEQ ID NO: 6511) |
| 19 | QQTTLLLLLS | (SEQ ID NO: 6512) |
| 531 | SAVQNLQAKE | (SEQ ID NO: 6513) |
| 493 | FRANPNEPAK | (SEQ ID NO: 6514) |
| 491 | CDFRANPNEP | (SEQ ID NO: 6515) |
| 490 | QCDFRANPNE | (SEQ ID NO: 6516) |
| 460 | VMIFSVGKRR | (SEQ ID NO: 6517) |
| 453 | NKDLTSRVMI | (SEQ ID NO: 6518) |
| 365 | GRDRLPCMGD | (SEQ ID NO: 6519) |
| 349 | YPDVQTRVQA | (SEQ ID NO: 6520) |
| 347 | TRYPDVQTRV | (SEQ ID NO: 6521) |
| 328 | FGASQDTLST | (SEQ ID NO: 6522) |
| 325 | TDIFGASQDT | (SEQ ID NO: 6523) |
| 315 | LDLENVPATI | (SEQ ID NO: 6524) |
| 305 | AGDSHGGGAR | (SEQ ID NO: 6525) |
| 300 | AEKKAAGDSH | (SEQ ID NO: 6526) |
| 293 | MDAFILsAEK | (SEQ ID NO: 6527) |
| 285 | PGAAPRDMMD | (SEQ ID NO: 6528) |
| 250 | FPNPVRTVFR | (SEQ ID NO: 6529) |
| 236 | GAGSLVDVMP | (SEQ ID NO: 6530) |
| 188 | GAFLDPRPLT | (SEQ ID NO: 6531) |
| 141 | WKVQRRAAHS | (SEQ ID NO: 6532) |
| 140 | HWKVQRRAAH | (SEQ ID NO: 6533) |
| 121 | ASFRVVSGGR | (SEQ ID NO: 6534) |
| 118 | PAFASFRVVS | (SEQ ID NO: 6535) |
| 115 | ADRPAFASFR | (SEQ ID NO: 6536) |
| 112 | SAFADRPAFA | (SEQ ID NO: 6537) |
| 92 | CPIVVLNGER | (SEQ ID NO: 6538) |
| 62 | NAAAVGQAAH | (SEQ ID NO: 6539) |
| 61 | GNAAAVGQAA | (SEQ ID NO: 6540) |
| 56 | AWPLIGNAAA | (SEQ ID NO: 6541) |
| 55 | FAWPLIGNAA | (SEQ ID NO: 6542) |
| 51 | PPGPFAWPLI | (SEQ ID NO: 6543) |
| 526 | MELLDSAVQN | (SEQ ID NO: 6544) |
| 518 | VNVTLRESME | (SEQ ID NO: 6545) |
| 506 | SYGLTIKPKS | (SEQ ID NO: 6546) |
| 495 | ANPNEPAKMN | (SEQ ID NO: 6547) |
| 488 | AHQCDFRANP | (SEQ ID NO: 6548) |
| 463 | FSVGKRRCIG | (SEQ ID NO: 6549) |
| 458 | SRVMIFSVGK | (SEQ ID NO: 6550) |
| 443 | ARFLDKDGLI | (SEQ ID NO: 6551) |
| 432 | LKWPNPENFD | (SEQ ID NO: 6552) |
| 405 | ANTSVLGYHI | (SEQ ID NO: 6553) |
| 400 | PHATTANTSV | (SEQ ID NO: 6554) |
| 392 | SSFVPVTIPH | (SEQ ID NO: 6555) |
| 386 | YEAMRFSSFV | (SEQ ID NO: 6556) |
| 370 | PCMGDQPNLP | (SEQ ID NO: 6557) |
| 364 | VGRDRLPCMG | (SEQ ID NO: 6558) |
| 348 | RYPDVQTRVQ | (SEQ ID NO: 6559) |
| 331 | SQDTLSTALQ | (SEQ ID NO: 6560) |
| 313 | ARLDLENVPA | (SEQ ID NO: 6561) |
| 304 | AAGDSHGGGA | (SEQ ID NO: 6562) |
| 302 | KKAAGDSHGG | (SEQ ID NO: 6563) |
| 288 | APRDMMDAFI | (SEQ ID NO: 6564) |
| 280 | CESLRPGAAP | (SEQ ID NO: 6565) |
| 279 | HCESLRPGAA | (SEQ ID NO: 6566) |
| 273 | LDKFLRHCES | (SEQ ID NO: 6567) |
| 269 | SNFILDKFLR | (SEQ ID NO: 6568) |
| 247 | LQYFPNPVRT | (SEQ ID NO: 6569) |
| 228 | NEEFGRTVGA | (SEQ ID NO: 6570) |
| 227 | HNEEFGRTVG | (SEQ ID NO: 6571) |
| 226 | SHNEEFGRTV | (SEQ ID NO: 6572) |
| 214 | YSHDDPEFRE | (SEQ ID NO: 6573) |
| 194 | RPLTVVAVAN | (SEQ ID NO: 6574) |
| 191 | LDPRPLTVVA | (SEQ ID NO: 6575) |
| 186 | ADGAFLDPRP | (SEQ ID NO: 6576) |
| 178 | VALLVRGSAD | (SEQ ID NO: 6577) |
| 161 | RSRQVLEGHV | (SEQ ID NO: 6578) |
| 158 | RQPRSRQVLE | (SEQ ID NO: 6579) |
| 144 | QRRAAHSMMR | (SEQ ID NO: 6580) |
| 109 | QQGSAFADRP | (SEQ ID NO: 6581) |
| 104 | HQALVQQGSA | (SEQ ID NO: 6582) |
| 103 | IHQALVQQGS | (SEQ ID NO: 6583) |
| 87 | IRLGSCPIVV | (SEQ ID NO: 6584) |
| 85 | FQIRLGSCPI | (SEQ ID NO: 6585) |
| 70 | AHLSFARLAR | (SEQ ID NO: 6586) |
| 67 | GQAAHLSFAR | (SEQ ID NO: 6587) |
| 64 | AAVGQAAHLS | (SEQ ID NO: 6588) |
| 57 | WPLIGNAAAV | (SEQ ID NO: 6589) |
| 45 | RQLRSAPPGP | (SEQ ID NO: 6590) |
| 43 | RRRQLRSAPP | (SEQ ID NO: 6591) |
| 42 | QRRRQLRSAP | (SEQ ID NO: 6592) |
| 35 | VGQRLLRQRR | (SEQ ID NO: 6593) |
| 13 | LNPLSIQQTT | (SEQ ID NO: 6594) |
| 8 | NDPWPLNPLS | (SEQ ID NO: 6595) |
| 6 | SPNDPWPLNP | (SEQ ID NO: 6596) |
| 5 | LSPNDPWPLN | (SEQ ID NO: 6597) |
| 3 | TSLSPNDPWP | (SEQ ID NO: 6598) |
| 534 | QNLQAKETCQ | (SEQ ID NO: 6599) |
| 529 | LDSAVQNLQA | (SEQ ID NO: 6600) |
| 525 | SMELLDSAVQ | (SEQ ID NO: 6601) |
| 489 | HQCDFRANPN | (SEQ ID NO: 6602) |
| 468 | RRCIGEELSK | (SEQ ID NO: 6603) |
| 433 | KWPNPENFDP | (SEQ ID NO: 6604) |
| 429 | HDPLKWPNPE | (SEQ ID NO: 6605) |
| 427 | VNHDPLKWPN | (SEQ ID NO: 6606) |
| 425 | WSVNHDPLKW | (SEQ ID NO: 6607) |
| 424 | QWSVNHDPLK | (SEQ ID NO: 6608) |
| 395 | VPVTIPHATT | (SEQ ID NO: 6609) |
| 332 | QDTLSTALQW | (SEQ ID NO: 6610) |
| 320 | VPATLTDLFG | (SEQ ID NO: 6611) |
| 310 | GGGARLDLEN | (SEQ ID NO: 6612) |
| 299 | SAEKKAAGDS | (SEQ ID NO: 6613) |
| 261 | FEQLNRNFSN | (SEQ ID NO: 6614) |
| 254 | VRTVFREFEQ | (SEQ ID NO: 6615) |
| 245 | PWLQYFPNPV | (SEQ ID NO: 6616) |
| 232 | GRTVGAGSLV | (SEQ ID NO: 6617) |
| 221 | FRELLSHNEE | (SEQ ID NO: 6618) |
| 166 | LEGHVLSEAR | (SEQ ID NO: 6619) |
| 163 | RQVLEGHVLS | (SEQ ID NO: 6620) |
| 152 | MRNFFTRQPR | (SEQ ID NO: 6621) |
| 151 | MMRNFFTRQP | (SEQ ID NO: 6622) |
| 138 | SEHWKVQRRA | (SEQ ID NO: 6623) |
| 135 | GHYSEHWKVQ | (SEQ ID NO: 6624) |
| 134 | FGHYSEHWKV | (SEQ ID NO: 6625) |
| 130 | RSMAFGHYSE | (SEQ ID NO: 6626) |
| 127 | SGGRSMAFGH | (SEQ ID NO: 6627) |
| 99 | GERAIHQALV | (SEQ ID NO: 6628) |
| 82 | GDVFQIRLGS | (SEQ ID NO: 6629) |
| 77 | LARRYGDVFQ | (SEQ ID NO: 6630) |
| 74 | FARLARRYGD | (SEQ ID NO: 6631) |
| 52 | PGPFAWPLIG | (SEQ ID NO: 6632) |
| 47 | LRSAPPGPFA | (SEQ ID NO: 6633) |
| 44 | RRQLRSAPPG | (SEQ ID NO: 6634) |
| 40 | LRQRRRQLRS | (SEQ ID NO: 6635) |
| 37 | QRLLRQRRRQ | (SEQ ID NO: 6636) |

-continued

| | | |
|---|---|---|
| 36 | GQRLLRQRRR | (SEQ ID NO: 6637) |
| 11 | WPLNPLSIQQ | (SEQ ID NO: 6638) |
| 1 | MGTSLSPNDP | (SEQ ID NO: 6639) |

Prediction of HLA binding peptides from cytochrome P450 1B1
Using the algorithm on the BIMAS website

| HLA-allele | Peptide | rank | starting position | sequence | score |
|---|---|---|---|---|---|
| A1 | 9mer | 1 | 372 | MGDQPNLPY (SEQ ID NO. 104) | 31.25 |
| | | 2 | 137 | YSEHWKVQR (SEQ ID NO. 105) | 27 |
| | 10mer | 1 | 240 | LVDVmPWLQY (SEQ ID NO. 106) | 125 |
| | | 2 | 439 | NFD)PaRFLDK (SEQ ID NO. 107) | 25 |
| A_1101 | 9mer | 1 | 459 | RVMIFSVGK (SEQ ID NO. 108) | 12 |
| | | 2 | 408 | SVLGYHIPK (SEQ ID NO. 109) | 6 |
| | 10mer | 1 | 459 | RVMIfSVGKR (SEQ ID NO. 110) | 2.4 |
| | | 2 | 508 | GLTIkPKSFK (SEQ ID NO. 111) | 1.2 |
| A_0201 | 9mer | 1 | 246 | WLQYFPNPV (SEQ ID NO. 112) | 1215.769 |
| | | 2 | 239 | SLVDVMPWL (SEQ ID NO. 113) | 1107.961 |
| | 10mer | 1 | 24 | LLLLsVLATV (SEQ ID NO. 114) | 1006.209 |
| | | 2 | 343 | LLLFtRYPDV (SEQ ID NO. 115) | 656.223 |
| A_0205 | 9mer | 1 | 479 | QLFLFISIL (SEQ ID NO. 116) | 84 |
| | | 2 | 239 | SLVDVMPWL (SEQ ID NO. 117) | 42 |
| | 10mer | 1 | 478 | MQLFIFISIL (SEQ ID NO. 118) | 114.24 |
| | | 2 | 24 | LLLLsVLATV (SEQ ID NO. 119) | 20.4 |
| A3 | 9mer | 1 | 150 | SMMRNFFTR (SEQ ID NO. 120) | 54 |
| | | 2 | 408 | SVLGYHIPK (SEQ ID NO. 121) | 27 |
| | 10mer | 1 | 508 | GLTIkPKSFK (SEQ ID NO. 122) | 90 |
| | | 2 | 445 | FLDKdGLINK (SEQ ID NO. 123) | 60 |
| A_3101 | 9mer | 1 | 150 | SMMRNFFTR (SEQ ID NO. 124) | 36 |
| | | 2 | 460 | VMIFSVGKR (SEQ ID NO. 125) | 8 |
| | 10mer | 1 | 459 | RVMIfSVGKR (SEQ ID NO. 126) | 36 |
| | | 2 | 339 | LQWLILLFTR (SEQ ID NO. 127) | 36 |
| A_3302 | 9mer | 1 | 72 | LSFARLARR (SEQ ID NO. 128) | 15 |
| | | 2 | 225 | LSHNEEFGR (SEQ ID NO. 129) | 15 |
| | 10mer | 1 | 281 | ESLRpGAAPR (SEQ ID NO. 130) | 45 |
| | | 2 | 359 | ELDQvVGRDR (SEQ ID NO. 131) | 27 |
| A24 | 9mer | 1 | 213 | RYSHDDPEF (SEQ ID NO. 132) | 220 |
| | | 2 | 275 | KFLRHCESL (SEQ ID NO. 133) | 60 |
| | 10mer | 1 | 80 | RYGDvFQIRL (SEQ ID NO. 134) | 480 |
| | | 2 | 385 | LYEAmRFSSF (SEQ ID NO. 135) | 180 |

-continued

Prediction of HLA binding peptides from cytochrome P450 1B1
Using the algorithm on the BIMAS website

| HLA-allele | Peptide | rank | starting position | sequence | score |
|---|---|---|---|---|---|
| A68.1 | 9mer | 1 | 408 | SVLGYHIPK (SEQ ID NO. 136) | 240 |
| | | 2 | 459 | RVMIFSVGK (SEQ ID NO. 137) | 240 |
| | 10mer | 1 | 459 | RVMIfSVGKR (SEQ ID NO. 138) | 400 |
| | | 2 | 34 | HVGQrLLRQR (SEQ ID NO. 139) | 400 |
| B7 | 9mer | 1 | 173 | EARELVALL (SEQ ID NO. 140) | 120 |
| | | 2 | 39 | LLRQRRRQL (SEQ ID NO. 141) | 60 |
| | 10mer | 1 | 50 | APPGpFAWPL (SEQ ID NO. 142) | 240 |
| | | 2 | 288 | APRDmMDAFI (SEQ ID NO. 143) | 240 |
| B8 | 9mer | 1 | 39 | LLRQRRRQL (SEQ ID NO. 144) | 160 |
| | | 2 | 173 | EARELVALL (SEQ ID NO. 145) | 48 |
| | 10mer | 1 | 156 | FTRQpRSRQV (SEQ ID NO. 146) | 12 |
| | | 2 | 512 | KPKSfKVNVI (SEQ ID NO. 147) | 8 |
| B14 | 9mer | 1 | 443 | ARFLDKDGL (SEQ ID NO. 148) | 100 |
| | | 2 | 361 | DQVVGRDRL (SEQ ID NO. 149) | 45 |
| | 10mer | 1 | 38 | RLLRqRRRQL (SEQ ID NO. 150) | 250 |
| | | 2 | 75 | ARLArRYGDV (SEQ ID NO. 151) | 200 |
| B_2702 | 9mer | 1 | 79 | RRYGDVFQI (SEQ ID NO. 152) | 900 |
| | | 2 | 443 | ARFLDKDGL (SEQ ID NO. 153) | 300 |
| | 10mer | 1 | 212 | CRYShDDPEF (SEQ ID NO. 154) | 1000 |
| | | 2 | 443 | ARFLdKDGLI (SEQ ID NO. 155) | 300 |
| B_2705 | 9mer | 1 | 443 | ARFLDKDGL (SEQ ID NO. 156) | 10000 |
| | | 2 | 79 | RRYGDVFQI (SEQ ID NO. 157) | 9000 |
| | 10mer | 1 | 79 | RRYGdVFQIR (SEQ ID NO. 158) | 15000 |
| | | 2 | 468 | RRCLgEELSK (SEQ ID NO. 159) | 6000 |
| B40 | 9mer | 1 | 229 | EEFGRTVGA (SEQ ID NO. 160) | 80 |
| | | 2 | 172 | SEARELVAL (SEQ ID NO. 161) | 40 |
| | 10mer | 1 | 473 | EELSkMQLFL (SEQ ID NO. 162) | 40 |
| | | 2 | '172 | SEAReLVALL (SEQ ID NO. 163) | 40 |
| B60 | 9mer | 1 | 172 | SEARELVAL (SEQ ID NO. 164) | 640 |
| | | 2 | 472 | GEELSKMQL (SEQ ID NO. 165) | 352 |
| | 10mer | 1 | 473 | EELSkMQLFL (SEQ ID NO. 166) | 640 |
| | | 2 | 172 | SEAReLVALL (SEQ ID NO. 167) | 352 |
| B61 | 9mer | 1 | 229 | EEFGRTVGA (SEQ ID NO. 168) | 60 |
| | | 2 | 280 | CESLRPGAA (SEQ ID NO. 169) | 20 |
| | 10mer | 1 | 46 | QLRSaPPGPF (SEQ ID NO. 170) | 120 |
| | | 2 | 377 | NLPYvLAFLY (SEQ ID NO. 171) | 80 |

-continued

Prediction of HLA binding peptides from cytochrome P450 1B1
Using the algorithm on the BIMAS website

| HLA-allele | Peptide | rank | starting position | sequence | score |
|---|---|---|---|---|---|
| B62 | 9mer | 1 | 338 | ALQWLLLLF (SEQ ID NO. 172) | 96 |
|  |  | 2 | 341 | WLLLLFTRY (SEQ ID NO. 173) | 96 |
|  | 10mer | 1 | 46 | QLRSaPPGPF (SEQ ID NO. 174) | 120 |
|  |  | 2 | 377 | NLPYvLAFLY (SEQ ID NO. 175) | 80 |
| B_3501 | 9mer | 1 | 288 | APRDMMDAF (SEQ ID NO. 176) | 120 |
|  |  | 2 | 284 | RPGAAPRDM (SEQ ID NO. 177) | 80 |
|  | 10mer | 1 | 284 | RPGAaPRDMM (SEQ ID NO. 178) | 80 |
|  |  | 2 | 288 | APRDMDAFT (SEQ ID NO. 179) | 48 |
| B_3701 | 9mer | 1 | 217 | DDPEFRELL (SEQ ID NO. 180) | 200 |
|  |  | 2 | 454 | KDLTSRVMI (SEQ ID NO. 181) | 200 |
|  | 10mer | 1 | 148 | AHSMMRNFF (SEQ ID NO. 182) | 39 |
|  |  | 2 | 428 | NHDPLKWPN (SEQ ID NO. 183) | 11.7 |
| B_3801 | 9mer | 1 | 148 | AHSMMRNFF (SEQ ID NO. 184) | 39 |
|  |  | 2 | 428 | NHDPLKWPN (SEQ ID NO. 185) | 11.7 |
|  | 10mer | 1 | 148 | AHSMMRNFF (SEQ ID NO. 186) | 39 |
|  |  | 2 | 428 | NHDPLKWPN (SEQ ID NO. 187) | 11.7 |
| B_3901 | 9mer | 1 | 135 | GHYSEHWKV (SEQ ID NO. 188) | 60 |
|  |  | 2 | 412 | YHIPKDTVV (SEQ ID NO. 189) | 30 |
|  | 10mer | 1 | 215 | SHDDpEFREL (SEQ ID NO. 190) | 540 |
|  |  | 2 | 168 | GHVLsEAREL (SEQ ID NO. 191) | 180 |
| B_3902 | 9mer | 1 | 19 | QQTTLLLLL (SEQ ID NO. 192) | 24 |
|  |  | 2 | 374 | DQPNLPYVL (SEQ ID NO. 193) | 24 |
|  | 10mer | 1 | 447 | DKDGIINKDL (SEQ ID NO. 194) | 24 |
|  |  | 2 | 478 | MQLFIFISIL (SEQ ID NO. 195) | 24 |
| B_4403 | 9mer | 1 | 473 | EELSKMQLF (SEQ ID NO. 196) | 120 |
|  |  | 2 | 386 | YEAMRFSSF (SEQ ID NO. 197) | 80 |
|  | 10mer | 1 | 498 | NEPAkMNFSY (SEQ ID NO. 198) | 180 |
|  |  | 2 | 222 | RELLsHNE.EF (SEQ ID NO. 199) | 80 |
| B_5101 | 9mer | 1 | 414 | IPKDTVVFV (SEQ ID NO. 200) | 314.6 |
|  |  | 2 | 387 | EAMRFSSFV (SEQ ID NO. 201) | 200 |
|  | 10mer | 1 | 9 | DPWPINPLSI (SEQ ID NO. 202) | 1600 |
|  |  | 2 | 288 | APRDmMDAFI (SEQ ID NO. 203) | 440 |
| B_5102 | 9mer | 1 | 117 | RPAFASFRV (SEQ ID NO. 204) | 400 |
|  |  | 2 | 188 | GAFLDPRPL (SEQ ID NO. 205) | 302.5 |
|  | 10mer | 1 | 9 | DPWPINPLSI (SEQ ID NO. 206) | 2200 |
|  |  | 2 | 57 | WPLIgNAAAV (SEQ ID NO. 207) | 660 |
| B_5103 | 9mer | 1 | 401 | HATTANTSV (SEQ ID NO. 208) | 121 |
|  |  | 2 | 387 | EAMRFSSFV (SEQ ID NO. 209) | 110 |
|  | 10mer | 1 | 410 | LGYHiPKDTV (SEQ ID NO. 210) | 132 |
|  |  | 2 | 199 | VAVAnVMSAV (SEQ ID NO. 211) | 121 |
| B_5201 | 9mer | 1 | 356 | VQAELDQVV (SEQ ID NO. 212) | 396 |
|  |  | 2 | 374 | DQPNLPYVL (SEQ ID NO. 213) | 88 |
|  | 10mer | 1 | 478 | MQLFIFISIL (SEQ ID NO. 214) | 90 |
|  |  | 2 | 117 | RPAFaSFRVV (SEQ ID NO. 215) | 50 |
| B_5801 | 9mer | 1 | 238 | GSLVDVMPW (SEQ ID NO. 216) | 105.6 |
|  |  | 2 | 49 | SAPPGPFAW (SEQ ID NO. 217) | 80 |
|  | 10mer | 1 | 48 | RSAPpGPFAW (SEQ ID NO. 218) | 480 |
|  |  | 2 | 146 | RAAHsMMRNF (SEQ ID NO. 219) | 99 |

SEQUENCE LISTING (6564 sequences)

SEQ ID NO: 1 - protein, 9 aa, Homo sapiens
LLLSVLATV

SEQ ID NO: 2 - protein, 9 aa, Homo sapiens
TLLLLLSVL

SEQ ID NO: 3 - protein, 9 aa, Homo sapiens
LLDSAVQNL

SEQ ID NO: 4 - protein, 9 aa, Homo sapiens
QLFLFISIL

SEQ ID NO: 5 - protein, 9 aa, Homo sapiens
FLDPRPLTV

SEQ ID NO: 6 - protein, 9 aa, Homo sapiens
NLPYVLAFL

SEQ ID NO: 7 - protein, 9 aa, Homo sapiens
LLFTRYPDV

SEQ ID NO: 8 - protein, 9 aa, Homo sapiens
TLSTALQWL

SEQ ID NO: 9 - protein, 9 aa, Homo sapiens
SLVDVMPWL

SEQ ID NO: 10 - protein, 9 aa, Homo sapiens
PLIGNAAAV

SEQ ID NO: 11 - protein, 9 aa, Homo sapiens
LLLLSVLAT

SEQ ID NO: 12 - protein, 9 aa, Homo sapiens
TTLLLLLSV

SEQ ID NO: 13 - protein, 9 aa, Homo sapiens
VLSEARELV

SEQ ID NO: 14 - protein, 9 aa, Homo sapiens
SIQQTTLLL

SEQ ID NO: 15 - protein, 9 aa, Homo sapiens
TLRESMELL

SEQ ID NO: 16 - protein, 9 aa, Homo sapiens
TIKPKSFKV

SEQ ID NO: 17 - protein, 9 aa, Homo sapiens
LTVVAVANV

SEQ ID NO: 18 - protein, 9 aa, Homo sapiens
RLARRYGDV

SEQ ID NO: 19 - protein, 9 aa, Homo sapiens
LLRQRRRQL

SEQ ID NO: 20 - protein, 9 aa, Homo sapiens
SMELLDSAV

SEQ ID NO: 21 - protein, 9 aa, Homo sapiens
TALQWLLLL

SEQ ID NO: 22 - protein, 9 aa, Homo sapiens
WLQYFPNPV

SEQ ID NO: 23 - protein, 9 aa, Homo sapiens
VGAGSLVDV

SEQ ID NO: 24 - protein, 9 aa, Homo sapiens
SEARELVAL

SEQ ID NO: 25 - protein, 9 aa, Homo sapiens
LLLLLSVLA

SEQ ID NO: 26 - protein, 9 aa, Homo sapiens
CIGEELSKM

SEQ ID NO: 27 - protein, 9 aa, Homo sapiens
YVLAFLYEA

SEQ ID NO: 28 - protein, 9 aa, Homo sapiens
DLENVPATI

SEQ ID NO: 29 - protein, 9 aa, Homo sapiens
MMDAFILSA

SEQ ID NO: 30 - protein, 9 aa, Homo sapiens
EARELVALL

SEQ ID NO: 31 - protein, 9 aa, Homo sapiens
RLGSCPIVV

SEQ ID NO: 32 - protein, 9 aa, Homo sapiens
AAVGQAAHL

SEQ ID NO: 33 - protein, 9 aa, Homo sapiens
VTLRESMEL

SEQ ID NO: 34 - protein, 9 aa, Homo sapiens
STALQWLLL

SEQ ID NO: 35 - protein, 9 aa, Homo sapiens
GARLDLENV

SEQ ID NO: 36 - protein, 9 aa, Homo sapiens
YFPNPVRTV

SEQ ID NO: 37 - protein, 9 aa, Homo sapiens
AVANVMSAV

SEQ ID NO: 38 - protein, 9 aa, Homo sapiens
VLEGHVLSE

SEQ ID NO: 39 - protein, 9 aa, Homo sapiens
LGSCPIVVL

SEQ ID NO: 40 - protein, 9 aa, Homo sapiens
PLSIQQTTL

SEQ ID NO: 41 - protein, 9 aa, Homo sapiens
FLFISILAH

SEQ ID NO: 42 - protein, 9 aa, Homo sapiens
ELSKMQLFL

SEQ ID NO: 43 - protein, 9 aa, Homo sapiens
VVFVNQWSV

SEQ ID NO: 44 - protein, 9 aa, Homo sapiens
IPKDTVVFV

SEQ ID NO: 45 - protein, 9 aa, Homo sapiens
VLAFLYEAM

SEQ ID NO: 46 - protein, 9 aa, Homo sapiens
GDQPNLPYV

SEQ ID NO: 47 - protein, 9 aa, Homo sapiens
RVQAELDQV

SEQ ID NO: 48 - protein, 9 aa, Homo sapiens
ALQWLLLLF

SEQ ID NO: 49 - protein, 9 aa, Homo sapiens
SLRPGAAPR

SEQ ID NO: 50 - protein, 9 aa, Homo sapiens
HVLSEAREL

SEQ ID NO: 51 - protein, 9 aa, Homo sapiens
VVLNGERAI

SEQ ID NO: 52 - protein, 9 aa, Homo sapiens
QIRLGSCPI

SEQ ID NO: 53 - protein, 9 aa, Homo sapiens
AAHLSFARL

SEQ ID NO: 54 - protein, 9 aa, Homo sapiens
LINKDLTSR

SEQ ID NO: 55 - protein, 9 aa, Homo sapiens
GLINKDLTS

SEQ ID NO: 56 - protein, 9 aa, Homo sapiens
YHIPKDTVV

SEQ ID NO: 57 - protein, 9 aa, Homo sapiens
VLGYHIPKD

SEQ ID NO: 58 - protein, 9 aa, Homo sapiens
ATTANTSVL

SEQ ID NO: 59 - protein, 9 aa, Homo sapiens
LLLLFTRYP

SEQ ID NO: 60 - protein, 9 aa, Homo sapiens
ATITDIFGA

SEQ ID NO: 61 - protein, 9 aa, Homo sapiens
ILDKFLRHC

SEQ ID NO: 62 - protein, 9 aa, Homo sapiens
LDPRPLTVV

SEQ ID NO: 63 - protein, 9 aa, Homo sapiens
IRLGSCPIV

SEQ ID NO: 64 - protein, 9 aa, Homo sapiens
FAWPLIGNA

SEQ ID NO: 65 - protein, 9 aa, Homo sapiens
IQQTTLLLL

SEQ ID NO: 66 - protein, 9 aa, Homo sapiens
KSFKVNVTL

SEQ ID NO: 67 - protein, 9 aa, Homo sapiens
AKMNFSYGL

SEQ ID NO: 68 - protein, 9 aa, Homo sapiens
VMIFSVGKR

SEQ ID NO: 69 - protein, 9 aa, Homo sapiens
TSRVMIFSV

SEQ ID NO: 70 - protein, 9 aa, Homo sapiens
VQAELDQVV

SEQ ID NO: 71 - protein, 9 aa, Homo sapiens
NVPATITDI

SEQ ID NO: 72 - protein, 9 aa, Homo sapiens
LDLENVPAT

SEQ ID NO: 73 - protein, 9 aa, Homo sapiens
RLDLENVPA

SEQ ID NO: 74 - protein, 9 aa, Homo sapiens
ILSAEKKAA

SEQ ID NO: 75 - protein, 9 aa, Homo sapiens
FILSAEKKA

SEQ ID NO: 76 - protein, 9 aa, Homo sapiens
RTVGAGSLV

SEQ ID NO: 77 - protein, 9 aa, Homo sapiens
GAFLDPRPL

SEQ ID NO: 78 - protein, 9 aa, Homo sapiens
LLVRGSADG

SEQ ID NO: 79 - protein, 9 aa, Homo sapiens
SMAFGHYSE

SEQ ID NO: 80 - protein, 9 aa, Homo sapiens
AIHQALVQQ

SEQ ID NO: 81 - protein, 9 aa, Homo sapiens
VLNGERAIH

SEQ ID NO: 82 - protein, 9 aa, Homo sapiens
TVHVGQRLL

SEQ ID NO: 83 - protein, 9 aa, Homo sapiens
ATVHVGQRL

SEQ ID NO: 84 - protein, 9 aa, Homo sapiens
VLATVHVGQ

SEQ ID NO: 85 - protein, 9 aa, Homo sapiens
LSVLATVHV

SEQ ID NO: 86 - protein, 9 aa, Homo sapiens
LSIQQTTLL

SEQ ID NO: 87 - protein, 9 aa, Homo sapiens
NDPWPLNPL

SEQ ID NO: 88 - protein, 9 aa, Homo sapiens
INKDLTSRV

SEQ ID NO: 89 - protein, 9 aa, Homo sapiens
HATTANTSV

SEQ ID NO: 90 - protein, 9 aa, Homo sapiens
VTIPHATTA

SEQ ID NO: 91 - protein, 9 aa, Homo sapiens
DSHGGGARL

SEQ ID NO: 92 - protein, 9 aa, Homo sapiens
KFLRHCESL

SEQ ID NO: 93 - protein, 9 aa, Homo sapiens
TVFREFEQL

SEQ ID NO: 94 - protein, 9 aa, Homo sapiens
VAVANVMSA

SEQ ID NO: 95 - protein, 9 aa, Homo sapiens
ALLVRGSAD

SEQ ID NO: 96 - protein, 9 aa, Homo sapiens
RRYGDVFQI

SEQ ID NO: 97 - protein, 9 aa, Homo sapiens
QQTTLLLLL

SEQ ID NO: 98 - protein, 9 aa, Homo sapiens
SLSPNDPWP

SEQ ID NO: 99 - protein, 9 aa, Homo sapiens
ILAHQCDFR

SEQ ID NO: 100 - protein, 9 aa, Homo sapiens
KMQLFLFIS

SEQ ID NO: 101 - protein, 9 aa, Homo sapiens
ARFLDKDGL

SEQ ID NO: 102 - protein, 9 aa, Homo sapiens
GYHIPKDTV

SEQ ID NO: 103 - protein, 9 aa, Homo sapiens
NTSVLGYHI

SEQ ID NO: 104 - protein, 9 aa, Homo sapiens
FVPVTIPHA

SEQ ID NO: 105 - protein, 9 aa, Homo sapiens
FLYEAMRFS

SEQ ID NO: 106 - protein, 9 aa, Homo sapiens
VQTRVQAEL

SEQ ID NO: 107 - protein, 9 aa, Homo sapiens
LLLFTRYPD

SEQ ID NO: 108 - protein, 9 aa, Homo sapiens
SQDTLSTAL

SEQ ID NO: 109 - protein, 9 aa, Homo sapiens
GASQDTLST

SEQ ID NO: 110 - protein, 9 aa, Homo sapiens
IFGASQDTL

SEQ ID NO: 111 - protein, 9 aa, Homo sapiens
DIFGASQDT

SEQ ID NO: 112 - protein, 9 aa, Homo sapiens
FILDKFLRH

SEQ ID NO: 113 - protein, 9 aa, Homo sapiens
GAGSLVDVM

SEQ ID NO: 114 - protein, 9 aa, Homo sapiens
GRTVGAGSL

SEQ ID NO: 115 - protein, 9 aa, Homo sapiens
HNEEFGRTV

SEQ ID NO: 116 - protein, 9 aa, Homo sapiens
HDDPEFREL

SEQ ID NO: 117 - protein, 9 aa, Homo sapiens
PRPLTVVAV

SEQ ID NO: 118 - protein, 9 aa, Homo sapiens
LVALLVRGS

SEQ ID NO: 119 - protein, 9 aa, Homo sapiens
ELVALLVRG

SEQ ID NO: 120 - protein, 9 aa, Homo sapiens
GHYSEHWKV

SEQ ID NO: 121 - protein, 9 aa, Homo sapiens
LVQQGSAFA

SEQ ID NO: 122 - protein, 9 aa, Homo sapiens
KPKSFKVNV

SEQ ID NO: 123 - protein, 9 aa, Homo sapiens
MNFSYGLTI

SEQ ID NO: 124 - protein, 9 aa, Homo sapiens
KMNFSYGLT

SEQ ID NO: 125 - protein, 9 aa, Homo sapiens
SKMQLFLFI

SEQ ID NO: 126 - protein, 9 aa, Homo sapiens
KRRCIGEEL

SEQ ID NO: 127 - protein, 9 aa, Homo sapiens
KDLTSRVMI

SEQ ID NO: 128 - protein, 9 aa, Homo sapiens
MRFSSFVPV

SEQ ID NO: 129 - protein, 9 aa, Homo sapiens
EAMRFSSFV

SEQ ID NO: 130 - protein, 9 aa, Homo sapiens
WLLLLFTRY

SEQ ID NO: 131 - protein, 9 aa, Homo sapiens
LQWLLLLFT

SEQ ID NO: 132 - protein, 9 aa, Homo sapiens
ASQDTLSTA

SEQ ID NO: 133 - protein, 9 aa, Homo sapiens
HGGGARLDL

SEQ ID NO: 134 - protein, 9 aa, Homo sapiens
SNFILDKFL

SEQ ID NO: 135 - protein, 9 aa, Homo sapiens
LVRGSADGA

SEQ ID NO: 136 - protein, 9 aa, Homo sapiens
VALLVRGSA

SEQ ID NO: 137 - protein, 9 aa, Homo sapiens
SRQVLEGHV

SEQ ID NO: 138 - protein, 9 aa, Homo sapiens
SMMRNFFTR

SEQ ID NO: 139 - protein, 9 aa, Homo sapiens
VVSGGRSMA

SEQ ID NO: 140 - protein, 9 aa, Homo sapiens
ALVQQGSAF

SEQ ID NO: 141 - protein, 9 aa, Homo sapiens
YGDVFQIRL

SEQ ID NO: 142 - protein, 9 aa, Homo sapiens
AAAVGQAAH

SEQ ID NO: 143 - protein, 9 aa, Homo sapiens
SVLATVHVG

SEQ ID NO: 144 - protein, 9 aa, Homo sapiens
LLSVLATVH

SEQ ID NO: 145 - protein, 9 aa, Homo sapiens
ELLDSAVQN

SEQ ID NO: 146 - protein, 9 aa, Homo sapiens
KVNVTLRES

SEQ ID NO: 147 - protein, 9 aa, Homo sapiens
GLTIKPKSF

SEQ ID NO: 148 - protein, 9 aa, Homo sapiens
SILAHQCDF

SEQ ID NO: 149 - protein, 9 aa, Homo sapiens
MQLFLFISI

SEQ ID NO: 150 - protein, 9 aa, Homo sapiens
FSVGKRRCI

SEQ ID NO: 151 - protein, 9 aa, Homo sapiens
DLTSRVMIF

SEQ ID NO: 152 - protein, 9 aa, Homo sapiens
FLDKDGLIN

SEQ ID NO: 153 - protein, 9 aa, Homo sapiens
RFLDKDGLI

SEQ ID NO: 154 - protein, 9 aa, Homo sapiens
HIPKDTVVF

SEQ ID NO: 155 - protein, 9 aa, Homo sapiens
FSSFVPVTI

SEQ ID NO: 156 - protein, 9 aa, Homo sapiens
AELDQVVGR

SEQ ID NO: 157 - protein, 9 aa, Homo sapiens
LSTALQWLL

SEQ ID NO: 158 - protein, 9 aa, Homo sapiens
LNRNFSNFI

SEQ ID NO: 159 - protein, 9 aa, Homo sapiens
LLSHNEEFG

SEQ ID NO: 160 - protein, 9 aa, Homo sapiens
DDPEFRELL

SEQ ID NO: 161 - protein, 9 aa, Homo sapiens
RPLTVVAVA

SEQ ID NO: 162 - protein, 9 aa, Homo sapiens
RGSADGAFL

SEQ ID NO: 163 - protein, 9 aa, Homo sapiens
ARELVALLV

SEQ ID NO: 164 - protein, 9 aa, Homo sapiens
LEGHVLSEA

SEQ ID NO: 165 - protein, 9 aa, Homo sapiens
QVLEGHVLS

SEQ ID NO: 166 - protein, 9 aa, Homo sapiens
TRQPRSRQV

SEQ ID NO: 167 - protein, 9 aa, Homo sapiens
RVVSGGRSM

SEQ ID NO: 168 - protein, 9 aa, Homo sapiens
FASFRVVSG

SEQ ID NO: 169 - protein, 9 aa, Homo sapiens
PAFASFRVV

SEQ ID NO: 170 - protein, 9 aa, Homo sapiens
QALVQQGSA

SEQ ID NO: 171 - protein, 9 aa, Homo sapiens
GERAIHQAL

SEQ ID NO: 172 - protein, 9 aa, Homo sapiens
LIGNAAAVG

SEQ ID NO: 173 - protein, 9 aa, Homo sapiens
QLRSAPPGP

SEQ ID NO: 174 - protein, 9 aa, Homo sapiens
RLLRQRRRQ

SEQ ID NO: 175 - protein, 9 aa, Homo sapiens
LSPNDPWPL

SEQ ID NO: 176 - protein, 9 aa, Homo sapiens
NLQAKETCQ

SEQ ID NO: 177 - protein, 9 aa, Homo sapiens
AVQNLQAKE

SEQ ID NO: 178 - protein, 9 aa, Homo sapiens
SAVQNLQAK

SEQ ID NO: 179 - protein, 9 aa, Homo sapiens
ESMELLDSA

SEQ ID NO: 180 - protein, 9 aa, Homo sapiens
FISILAHQC

SEQ ID NO: 181 - protein, 9 aa, Homo sapiens
SVLGYHIPK

SEQ ID NO: 182 - protein, 9 aa, Homo sapiens
TANTSVLGY

SEQ ID NO: 183 - protein, 9 aa, Homo sapiens
TIPHATTAN

SEQ ID NO: 184 - protein, 9 aa, Homo sapiens
DQPNLPYVL

SEQ ID NO: 185 - protein, 9 aa, Homo sapiens
PCMGDQPNL

SEQ ID NO: 186 - protein, 9 aa, Homo sapiens
VGRDRLPCM

SEQ ID NO: 187 - protein, 9 aa, Homo sapiens
DQVVGRDRL

SEQ ID NO: 188 - protein, 9 aa, Homo sapiens
ELDQVVGRD

SEQ ID NO: 189 - protein, 9 aa, Homo sapiens
RYPDVQTRV

SEQ ID NO: 190 - protein, 9 aa, Homo sapiens
FTRYPDVQT

SEQ ID NO: 191 - protein, 9 aa, Homo sapiens
ITDIFGASQ

SEQ ID NO: 192 - protein, 9 aa, Homo sapiens
KAAGDSHGG

SEQ ID NO: 193 - protein, 9 aa, Homo sapiens
RDMMDAFIL

SEQ ID NO: 194 - protein, 9 aa, Homo sapiens
FLRHCESLR

SEQ ID NO: 195 - protein, 9 aa, Homo sapiens
QLNRNFSNF

SEQ ID NO: 196 - protein, 9 aa, Homo sapiens
VMPWLQYFP

SEQ ID NO: 197 - protein, 9 aa, Homo sapiens
ELLSHNEEF

SEQ ID NO: 198 - protein, 9 aa, Homo sapiens
AFLDPRPLT

SEQ ID NO: 199 - protein, 9 aa, Homo sapiens
RQVLEGHVL

SEQ ID NO: 200 - protein, 9 aa, Homo sapiens
RPAFASFRV

SEQ ID NO: 201 - protein, 9 aa, Homo sapiens
AFADRPAFA

SEQ ID NO: 202 - protein, 9 aa, Homo sapiens
ERAIHQALV

SEQ ID NO: 203 - protein, 9 aa, Homo sapiens
HLSFARLAR

SEQ ID NO: 204 - protein, 9 aa, Homo sapiens
GQAAHLSFA

SEQ ID NO: 205 - protein, 9 aa, Homo sapiens
NAAAVGQAA

SEQ ID NO: 206 - protein, 9 aa, Homo sapiens
GNAAAVGQA

SEQ ID NO: 207 - protein, 9 aa, Homo sapiens
WPLIGNAAA

SEQ ID NO: 208 - protein, 9 aa, Homo sapiens
SAPPGPFAW

SEQ ID NO: 209 - protein, 9 aa, Homo sapiens
PLNPLSIQQ

SEQ ID NO: 210 - protein, 9 aa, Homo sapiens
ANPNEPAKM

SEQ ID NO: 211 - protein, 9 aa, Homo sapiens
LAHQCDFRA

SEQ ID NO: 212 - protein, 9 aa, Homo sapiens
LFISILAHQ

SEQ ID NO: 213 - protein, 9 aa, Homo sapiens
GEELSKMQL

SEQ ID NO: 214 - protein, 9 aa, Homo sapiens
KDGLINKDL

SEQ ID NO: 215 - protein, 9 aa, Homo sapiens
ENFDPARFL

SEQ ID NO: 216 - protein, 9 aa, Homo sapiens
PLKWPNPEN

SEQ ID NO: 217 - protein, 9 aa, Homo sapiens
SVNHDPLKW

SEQ ID NO: 218 - protein, 9 aa, Homo sapiens
QWSVNHDPL

SEQ ID NO: 219 - protein, 9 aa, Homo sapiens
IPHATTANT

SEQ ID NO: 220 - protein, 9 aa, Homo sapiens
RFSSFVPVT

SEQ ID NO: 221 - protein, 9 aa, Homo sapiens
LAFLYEAMR

SEQ ID NO: 222 - protein, 9 aa, Homo sapiens
CMGDQPNLP

SEQ ID NO: 223 - protein, 9 aa, Homo sapiens
RLPCMGDQP

SEQ ID NO: 224 - protein, 9 aa, Homo sapiens
LSAEKKAAG

SEQ ID NO: 225 - protein, 9 aa, Homo sapiens
AAPRDMMDA

SEQ ID NO: 226 - protein, 9 aa, Homo sapiens
NRNFSNFIL

SEQ ID NO: 227 - protein, 9 aa, Homo sapiens
DVMPWLQYF

SEQ ID NO: 228 - protein, 9 aa, Homo sapiens
VMSAVCFGC

SEQ ID NO: 229 - protein, 9 aa, Homo sapiens
DPRPLTVVA

SEQ ID NO: 230 - protein, 9 aa, Homo sapiens
RQPRSRQVL

SEQ ID NO: 231 - protein, 9 aa, Homo sapiens
IVVLNGERA

SEQ ID NO: 232 - protein, 9 aa, Homo sapiens
PPGPFAWPL

SEQ ID NO: 233 - protein, 9 aa, Homo sapiens
RSAPPGPFA

SEQ ID NO: 234 - protein, 9 aa, Homo sapiens
QRRRQLRSA

SEQ ID NO: 235 - protein, 9 aa, Homo sapiens
LNPLSIQQT

SEQ ID NO: 236 - protein, 9 aa, Homo sapiens
LTIKPKSFK

SEQ ID NO: 237 - protein, 9 aa, Homo sapiens
FSYGLTIKP

SEQ ID NO: 238 - protein, 9 aa, Homo sapiens
RANPNEPAK

SEQ ID NO: 239 - protein, 9 aa, Homo sapiens
RVMIFSVGK

SEQ ID NO: 240 - protein, 9 aa, Homo sapiens
DKDGLINKD

SEQ ID NO: 241 - protein, 9 aa, Homo sapiens
DTVVFVNQW

SEQ ID NO: 242 - protein, 9 aa, Homo sapiens
PVTIPHATT

SEQ ID NO: 243 - protein, 9 aa, Homo sapiens
AMRFSSFVP

SEQ ID NO: 244 - protein, 9 aa, Homo sapiens
TRYPDVQTR

SEQ ID NO: 245 - protein, 9 aa, Homo sapiens
QWLLLLFTR

SEQ ID NO: 246 - protein, 9 aa, Homo sapiens
TITDIFGAS

SEQ ID NO: 247 - protein, 9 aa, Homo sapiens
SAEKKAAGD

SEQ ID NO: 248 - protein, 9 aa, Homo sapiens
DAFILSAEK

SEQ ID NO: 249 - protein, 9 aa, Homo sapiens
DMMDAFILS

SEQ ID NO: 250 - protein, 9 aa, Homo sapiens
GAAPRDMMD

SEQ ID NO: 251 - protein, 9 aa, Homo sapiens
QYFPNPVRT

SEQ ID NO: 252 - protein, 9 aa, Homo sapiens
EEFGRTVGA

SEQ ID NO: 253 - protein, 9 aa, Homo sapiens
SHNEEFGRT

SEQ ID NO: 254 - protein, 9 aa, Homo sapiens
NVMSAVCFG

SEQ ID NO: 255 - protein, 9 aa, Homo sapiens
VVAVANVMS

SEQ ID NO: 256 - protein, 9 aa, Homo sapiens
TVVAVANVM

SEQ ID NO: 257 - protein, 9 aa, Homo sapiens
PLTVVAVAN

SEQ ID NO: 258 - protein, 9 aa, Homo sapiens
SADGAFLDP

SEQ ID NO: 259 - protein, 9 aa, Homo sapiens
MMRNFFTRQ

SEQ ID NO: 260 - protein, 9 aa, Homo sapiens
MAFGHYSEH

SEQ ID NO: 261 - protein, 9 aa, Homo sapiens
SAFADRPAF

SEQ ID NO: 262 - protein, 9 aa, Homo sapiens
GSCPIVVLN

SEQ ID NO: 263 - protein, 9 aa, Homo sapiens
LSFARLARR

SEQ ID NO: 264 - protein, 9 aa, Homo sapiens
AHLSFARLA

SEQ ID NO: 265 - protein, 9 aa, Homo sapiens
HVGQRLLRQ

SEQ ID NO: 266 - protein, 9 aa, Homo sapiens
LATVHVGQR

SEQ ID NO: 267 - protein, 9 aa, Homo sapiens
QTTLLLLLS

SEQ ID NO: 268 - protein, 9 aa, Homo sapiens
VNVTLRESM

SEQ ID NO: 269 - protein, 9 aa, Homo sapiens
FRANPNEPA

SEQ ID NO: 270 - protein, 9 aa, Homo sapiens
MIFSVGKRR

SEQ ID NO: 271 - protein, 9 aa, Homo sapiens
LDKDGLINK

SEQ ID NO: 272 - protein, 9 aa, Homo sapiens
DPARFLDKD

SEQ ID NO: 273 - protein, 9 aa, Homo sapiens
FVNQWSVNH

SEQ ID NO: 274 - protein, 9 aa, Homo sapiens
TTANTSVLG

SEQ ID NO: 275 - protein, 9 aa, Homo sapiens
SSFVPVTIP

SEQ ID NO: 276 - protein, 9 aa, Homo sapiens
PNLPYVLAF

SEQ ID NO: 277 - protein, 9 aa, Homo sapiens
QPNLPYVLA

SEQ ID NO: 278 - protein, 9 aa, Homo sapiens
DVQTRVQAE

SEQ ID NO: 279 - protein, 9 aa, Homo sapiens
LENVPATIT

SEQ ID NO: 280 - protein, 9 aa, Homo sapiens
AAGDSHGGG

SEQ ID NO: 281 - protein, 9 aa, Homo sapiens
REFEQLNRN

SEQ ID NO: 282 - protein, 9 aa, Homo sapiens
VANVMSAVC

SEQ ID NO: 283 - protein, 9 aa, Homo sapiens
VQRRAAHSM

SEQ ID NO: 284 - protein, 9 aa, Homo sapiens
ASFRVVSGG

SEQ ID NO: 285 - protein, 9 aa, Homo sapiens
ADRPAFASF

SEQ ID NO: 286 - protein, 9 aa, Homo sapiens
NGERAIHQA

SEQ ID NO: 287 - protein, 9 aa, Homo sapiens
PIVVLNGER

SEQ ID NO: 288 - protein, 9 aa, Homo sapiens
CPIVVLNGE

SEQ ID NO: 289 - protein, 9 aa, Homo sapiens
QAAHLSFAR

SEQ ID NO: 290 - protein, 9 aa, Homo sapiens
AWPLIGNAA

SEQ ID NO: 291 - protein, 9 aa, Homo sapiens
NPLSIQQTT

SEQ ID NO: 292 - protein, 9 aa, Homo sapiens
PWPLNPLSI

SEQ ID NO: 293 - protein, 9 aa, Homo sapiens
VQNLQAKET

SEQ ID NO: 294 - protein, 9 aa, Homo sapiens
YGLTIKPKS

SEQ ID NO: 295 - protein, 9 aa, Homo sapiens
LFLFISILA

SEQ ID NO: 296 - protein, 9 aa, Homo sapiens
RCIGEELSK

SEQ ID NO: 297 - protein, 9 aa, Homo sapiens
GKRRCIGEE

SEQ ID NO: 298 - protein, 9 aa, Homo sapiens
VPVTIPHAT

SEQ ID NO: 299 - protein, 9 aa, Homo sapiens
ARLDLENVP

SEQ ID NO: 300 - protein, 9 aa, Homo sapiens
GGARLDLEN

SEQ ID NO: 301 - protein, 9 aa, Homo sapiens
AGDSHGGGA

SEQ ID NO: 302 - protein, 9 aa, Homo sapiens
PRDMMDAFI

SEQ ID NO: 303 - protein, 9 aa, Homo sapiens
FSNFILDKF

SEQ ID NO: 304 - protein, 9 aa, Homo sapiens
GSLVDVMPW

SEQ ID NO: 305 - protein, 9 aa, Homo sapiens
TVGAGSLVD

SEQ ID NO: 306 - protein, 9 aa, Homo sapiens
VCFGCRYSH

SEQ ID NO: 307 - protein, 9 aa, Homo sapiens
AVCFGCRYS

SEQ ID NO: 308 - protein, 9 aa, Homo sapiens
SAVCFGCRY

SEQ ID NO: 309 - protein, 9 aa, Homo sapiens
ADGAFLDPR

SEQ ID NO: 310 - protein, 9 aa, Homo sapiens
RELVALLVR

SEQ ID NO: 311 - protein, 9 aa, Homo sapiens
KVQRRAAHS

SEQ ID NO: 312 - protein, 9 aa, Homo sapiens
SEHWKVQRR

SEQ ID NO: 313 - protein, 9 aa, Homo sapiens
AFASFRVVS

SEQ ID NO: 314 - protein, 9 aa, Homo sapiens
FADRPAFAS

SEQ ID NO: 315 - protein, 9 aa, Homo sapiens
IHQALVQQG

SEQ ID NO: 316 - protein, 9 aa, Homo sapiens
RAIHQALVQ

SEQ ID NO: 317 - protein, 9 aa, Homo sapiens
SCPIVVLNG

SEQ ID NO: 318 - protein, 9 aa, Homo sapiens
VFQIRLGSC

SEQ ID NO: 319 - protein, 9 aa, Homo sapiens
LARRYGDVF

SEQ ID NO: 320 - protein, 9 aa, Homo sapiens
AVGQAAHLS

SEQ ID NO: 321 - protein, 9 aa, Homo sapiens
APPGPFAWP

SEQ ID NO: 322 - protein, 9 aa, Homo sapiens
WPLNPLSIQ

SEQ ID NO: 323 - protein, 9 aa, Homo sapiens
DSAVQNLQA

SEQ ID NO: 324 - protein, 9 aa, Homo sapiens
PKSFKVNVT

SEQ ID NO: 325 - protein, 9 aa, Homo sapiens
SVGKRRCIG

SEQ ID NO: 326 - protein, 9 aa, Homo sapiens
LTSRVMIFS

SEQ ID NO: 327 - protein, 9 aa, Homo sapiens
VNHDPLKWP

SEQ ID NO: 328 - protein, 9 aa, Homo sapiens
VNQWSVNHD

SEQ ID NO: 329 - protein, 9 aa, Homo sapiens
LGYHIPKDT

SEQ ID NO: 330 - protein, 9 aa, Homo sapiens
SFVPVTIPH

SEQ ID NO: 331 - protein, 9 aa, Homo sapiens
YEAMRFSSF

SEQ ID NO: 332 - protein, 9 aa, Homo sapiens
VVGRDRLPC

SEQ ID NO: 333 - protein, 9 aa, Homo sapiens
QVVGRDRLP

SEQ ID NO: 334 - protein, 9 aa, Homo sapiens
DTLSTALQW

SEQ ID NO: 335 - protein, 9 aa, Homo sapiens
SHGGGARLD

SEQ ID NO: 336 - protein, 9 aa, Homo sapiens
AFILSAEKK

SEQ ID NO: 337 - protein, 9 aa, Homo sapiens
MDAFILSAE

SEQ ID NO: 338 - protein, 9 aa, Homo sapiens
HCESLRPGA

SEQ ID NO: 339 - protein, 9 aa, Homo sapiens
RHCESLRPG

SEQ ID NO: 340 - protein, 9 aa, Homo sapiens
NFSNFILDK

SEQ ID NO: 341 - protein, 9 aa, Homo sapiens
LVDVMPWLQ

SEQ ID NO: 342 - protein, 9 aa, Homo sapiens
GSADGAFLD

SEQ ID NO: 343 - protein, 9 aa, Homo sapiens
LSEARELVA

SEQ ID NO: 344 - protein, 9 aa, Homo sapiens
FTRQPRSRQ

SEQ ID NO: 345 - protein, 9 aa, Homo sapiens
AAHSMMRNF

SEQ ID NO: 346 - protein, 9 aa, Homo sapiens
RAAHSMMRN

SEQ ID NO: 347 - protein, 9 aa, Homo sapiens
GSAFADRPA

SEQ ID NO: 348 - protein, 9 aa, Homo sapiens
DVFQIRLGS

SEQ ID NO: 349 - protein, 9 aa, Homo sapiens
ARLARRYGD

SEQ ID NO: 350 - protein, 9 aa, Homo sapiens
IGNAAAVGQ

SEQ ID NO: 351 - protein, 9 aa, Homo sapiens
VGQRLLRQR

SEQ ID NO: 352 - protein, 9 aa, Homo sapiens
SPNDPWPLN

SEQ ID NO: 353 - protein, 9 aa, Homo sapiens
GTSLSPNDP

SEQ ID NO: 354 - protein, 9 aa, Homo sapiens
RESMELLDS

SEQ ID NO: 355 - protein, 9 aa, Homo sapiens
SFKVNVTLR

SEQ ID NO: 356 - protein, 9 aa, Homo sapiens
SYGLTIKPK

SEQ ID NO: 357 - protein, 9 aa, Homo sapiens
NFSYGLTIK

SEQ ID NO: 358 - protein, 9 aa, Homo sapiens
LSKMQLFLF

SEQ ID NO: 359 - protein, 9 aa, Homo sapiens
DGLINKDLT

SEQ ID NO: 360 - protein, 9 aa, Homo sapiens
LKWPNPENF

SEQ ID NO: 361 - protein, 9 aa, Homo sapiens
ANTSVLGYH

SEQ ID NO: 362 - protein, 9 aa, Homo sapiens
QAELDQVVG

SEQ ID NO: 363 - protein, 9 aa, Homo sapiens
VPATITDIF

SEQ ID NO: 364 - protein, 9 aa, Homo sapiens
GGGARLDLE

SEQ ID NO: 365 - protein, 9 aa, Homo sapiens
KKAAGDSHG

SEQ ID NO: 366 - protein, 9 aa, Homo sapiens
LRPGAAPRD

SEQ ID NO: 367 - protein, 9 aa, Homo sapiens
CESLRPGAA

SEQ ID NO: 368 - protein, 9 aa, Homo sapiens
RTVFREFEQ

SEQ ID NO: 369 - protein, 9 aa, Homo sapiens
RELLSHNEE

SEQ ID NO: 370 - protein, 9 aa, Homo sapiens
PEFRELLSH

SEQ ID NO: 371 - protein, 9 aa, Homo sapiens
RSRQVLEGH

SEQ ID NO: 372 - protein, 9 aa, Homo sapiens
HSMMRNFFT

SEQ ID NO: 373 - protein, 9 aa, Homo sapiens
ARRYGDVFQ

SEQ ID NO: 374 - protein, 9 aa, Homo sapiens
FARLARRYG

SEQ ID NO: 375 - protein, 9 aa, Homo sapiens
SFARLARRY

SEQ ID NO: 376 - protein, 9 aa, Homo sapiens
PFAWPLIGN

SEQ ID NO: 377 - protein, 9 aa, Homo sapiens
PGPFAWPLI

SEQ ID NO: 378 - protein, 9 aa, Homo sapiens
QNLQAKETC

SEQ ID NO: 379 - protein, 9 aa, Homo sapiens
MELLDSAVQ

SEQ ID NO: 380 - protein, 9 aa, Homo sapiens
FKVNVTLRE

SEQ ID NO: 381 - protein, 9 aa, Homo sapiens
HQCDFRANP

SEQ ID NO: 382 - protein, 9 aa, Homo sapiens
ISILAHQCD

SEQ ID NO: 383 - protein, 9 aa, Homo sapiens
IFSVGKRRC

SEQ ID NO: 384 - protein, 9 aa, Homo sapiens
NKDLTSRVM

SEQ ID NO: 385 - protein, 9 aa, Homo sapiens
LPYVLAFLY

SEQ ID NO: 386 - protein, 9 aa, Homo sapiens
LPCMGDQPN

SEQ ID NO: 387 - protein, 9 aa, Homo sapiens
QTRVQAELD

SEQ ID NO: 388 - protein, 9 aa, Homo sapiens
YPDVQTRVQ

SEQ ID NO: 389 - protein, 9 aa, Homo sapiens
GDSHGGGAR

SEQ ID NO: 390 - protein, 9 aa, Homo sapiens
APRDMMDAF

SEQ ID NO: 391 - protein, 9 aa, Homo sapiens
PGAAPRDMM

SEQ ID NO: 392 - protein, 9 aa, Homo sapiens
RPGAAPRDM

SEQ ID NO: 393 - protein, 9 aa, Homo sapiens
VFREFEQLN

SEQ ID NO: 394 - protein, 9 aa, Homo sapiens
NPVRTVFRE

SEQ ID NO: 395 - protein, 9 aa, Homo sapiens
FPNPVRTVF

SEQ ID NO: 396 - protein, 9 aa, Homo sapiens
LQYFPNPVR

SEQ ID NO: 397 - protein, 9 aa, Homo sapiens
AGSLVDVMP

SEQ ID NO: 398 - protein, 9 aa, Homo sapiens
FGRTVGAGS

SEQ ID NO: 399 - protein, 9 aa, Homo sapiens
EFRELLSHN

SEQ ID NO: 400 - protein, 9 aa, Homo sapiens
SHDDPEFRE

SEQ ID NO: 401 - protein, 9 aa, Homo sapiens
ANVMSAVCF

SEQ ID NO: 402 - protein, 9 aa, Homo sapiens
PRSRQVLEG

SEQ ID NO: 403 - protein, 9 aa, Homo sapiens
QRRAAHSMM

SEQ ID NO: 404 - protein, 9 aa, Homo sapiens
HWKVQRRAA

SEQ ID NO: 405 - protein, 9 aa, Homo sapiens
SGGRSMAFG

SEQ ID NO: 406 - protein, 9 aa, Homo sapiens
VSGGRSMAF

SEQ ID NO: 407 - protein, 9 aa, Homo sapiens
VQQGSAFAD

SEQ ID NO: 408 - protein, 9 aa, Homo sapiens
LNGERAIHQ

SEQ ID NO: 409 - protein, 9 aa, Homo sapiens
FQIRLGSCP

SEQ ID NO: 410 - protein, 9 aa, Homo sapiens
GDVFQIRLG

SEQ ID NO: 411 - protein, 9 aa, Homo sapiens
VGQAAHLSF

SEQ ID NO: 412 - protein, 9 aa, Homo sapiens
VHVGQRLLR

SEQ ID NO: 413 - protein, 9 aa, Homo sapiens
DPWPLNPLS

SEQ ID NO: 414 - protein, 9 aa, Homo sapiens
LDSAVQNLQ

SEQ ID NO: 415 - protein, 9 aa, Homo sapiens
NVTLRESME

SEQ ID NO: 416 - protein, 9 aa, Homo sapiens
NPNEPAKMN

SEQ ID NO: 417 - protein, 9 aa, Homo sapiens
AHQCDFRAN

SEQ ID NO: 418 - protein, 9 aa, Homo sapiens
IGEELSKMQ

SEQ ID NO: 419 - protein, 9 aa, Homo sapiens
PNPENFDPA

SEQ ID NO: 420 - protein, 9 aa, Homo sapiens
WPNPENFDP

SEQ ID NO: 421 - protein, 9 aa, Homo sapiens
KWPNPENFD

SEQ ID NO: 422 - protein, 9 aa, Homo sapiens
NHDPLKWPN

SEQ ID NO: 423 - protein, 9 aa, Homo sapiens
TVVFVNQWS

SEQ ID NO: 424 - protein, 9 aa, Homo sapiens
TSVLGYHIP

SEQ ID NO: 425 - protein, 9 aa, Homo sapiens
LYEAMRFSS

SEQ ID NO: 426 - protein, 9 aa, Homo sapiens
AFLYEAMRF

SEQ ID NO: 427 - protein, 9 aa, Homo sapiens
DRLPCMGDQ

SEQ ID NO: 428 - protein, 9 aa, Homo sapiens
PDVQTRVQA

SEQ ID NO: 429 - protein, 9 aa, Homo sapiens
QDTLSTALQ

SEQ ID NO: 430 - protein, 9 aa, Homo sapiens
FGASQDTLS

SEQ ID NO: 431 - protein, 9 aa, Homo sapiens
TDIFGASQD

SEQ ID NO: 432 - protein, 9 aa, Homo sapiens
ENVPATITD

SEQ ID NO: 433 - protein, 9 aa, Homo sapiens
ESLRPGAAP

SEQ ID NO: 434 - protein, 9 aa, Homo sapiens
LRHCESLRP

SEQ ID NO: 435 - protein, 9 aa, Homo sapiens
PVRTVFREF

SEQ ID NO: 436 - protein, 9 aa, Homo sapiens
VDVMPWLQY

SEQ ID NO: 437 - protein, 9 aa, Homo sapiens
LSHNEEFGR

SEQ ID NO: 438 - protein, 9 aa, Homo sapiens
YSHDDPEFR

SEQ ID NO: 439 - protein, 9 aa, Homo sapiens
RYSHDDPEF

SEQ ID NO: 440 - protein, 9 aa, Homo sapiens
FGCRYSHDD

SEQ ID NO: 441 - protein, 9 aa, Homo sapiens
GHVLSEARE

SEQ ID NO: 442 - protein, 9 aa, Homo sapiens
MRNFFTRQP

SEQ ID NO: 443 - protein, 9 aa, Homo sapiens
AHSMMRNFF

SEQ ID NO: 444 - protein, 9 aa, Homo sapiens
WKVQRRAAH

SEQ ID NO: 445 - protein, 9 aa, Homo sapiens
YSEHWKVQR

SEQ ID NO: 446 - protein, 9 aa, Homo sapiens
AFGHYSEHW

SEQ ID NO: 447 - protein, 9 aa, Homo sapiens
RSMAFGHYS

SEQ ID NO: 448 - protein, 9 aa, Homo sapiens
SFRVVSGGR

SEQ ID NO: 449 - protein, 9 aa, Homo sapiens
HQALVQQGS

SEQ ID NO: 450 - protein, 9 aa, Homo sapiens
GPFAWPLIG

SEQ ID NO: 451 - protein, 9 aa, Homo sapiens
LRSAPPGPF

SEQ ID NO: 452 - protein, 9 aa, Homo sapiens
RQLRSAPPG

SEQ ID NO: 453 - protein, 9 aa, Homo sapiens
TSLSPNDPW

SEQ ID NO: 454 - protein, 9 aa, Homo sapiens
LRESMELLD

SEQ ID NO: 455 - protein, 9 aa, Homo sapiens
NEPAKMNFS

SEQ ID NO: 456 - protein, 9 aa, Homo sapiens
DFRANPNEP

SEQ ID NO: 457 - protein, 9 aa, Homo sapiens
CDFRANPNE

SEQ ID NO: 458 - protein, 9 aa, Homo sapiens
RRCIGEELS

SEQ ID NO: 459 - protein, 9 aa, Homo sapiens
SRVMIFSVG

SEQ ID NO: 460 - protein, 9 aa, Homo sapiens
FDPARFLDK

SEQ ID NO: 461 - protein, 9 aa, Homo sapiens
NFDPARFLD

SEQ ID NO: 462 - protein, 9 aa, Homo sapiens
NPENFDPAR

SEQ ID NO: 463 - protein, 9 aa, Homo sapiens
DPLKWPNPE

SEQ ID NO: 464 - protein, 9 aa, Homo sapiens
HDPLKWPNP

SEQ ID NO: 465 - protein, 9 aa, Homo sapiens
NQWSVNHDP

SEQ ID NO: 466 - protein, 9 aa, Homo sapiens
KDTVVFVNQ

SEQ ID NO: 467 - protein, 9 aa, Homo sapiens
PHATTANTS

SEQ ID NO: 468 - protein, 9 aa, Homo sapiens
MGDQPNLPY

SEQ ID NO: 469 - protein, 9 aa, Homo sapiens
RDRLPCMGD

SEQ ID NO: 470 - protein, 9 aa, Homo sapiens
GRDRLPCMG

SEQ ID NO: 471 - protein, 9 aa, Homo sapiens
LDQVVGRDR

SEQ ID NO: 472 - protein, 9 aa, Homo sapiens
LFTRYPDVQ

SEQ ID NO: 473 - protein, 9 aa, Homo sapiens
DKFLRHCES

SEQ ID NO: 474 - protein, 9 aa, Homo sapiens
LDKFLRHCE

SEQ ID NO: 475 - protein, 9 aa, Homo sapiens
NFILDKFLR

SEQ ID NO: 476 - protein, 9 aa, Homo sapiens
FEQLNRNFS

SEQ ID NO: 477 - protein, 9 aa, Homo sapiens
EFGRTVGAG

SEQ ID NO: 478 - protein, 9 aa, Homo sapiens
FRELLSHNE

SEQ ID NO: 479 - protein, 9 aa, Homo sapiens
MSAVCFGCR

SEQ ID NO: 480 - protein, 9 aa, Homo sapiens
DGAFLDPRP

SEQ ID NO: 481 - protein, 9 aa, Homo sapiens
VRGSADGAF

SEQ ID NO: 482 - protein, 9 aa, Homo sapiens
QPRSRQVLE

SEQ ID NO: 483 - protein, 9 aa, Homo sapiens
FFTRQPRSR

SEQ ID NO: 484 - protein, 9 aa, Homo sapiens
NFFTRQPRS

SEQ ID NO: 485 - protein, 9 aa, Homo sapiens
RRAAHSMMR

SEQ ID NO: 486 - protein, 9 aa, Homo sapiens
EHWKVQRRA

SEQ ID NO: 487 - protein, 9 aa, Homo sapiens
GGRSMAFGH

SEQ ID NO: 488 - protein, 9 aa, Homo sapiens
QQGSAFADR

SEQ ID NO: 489 - protein, 9 aa, Homo sapiens
RRQLRSAPP

SEQ ID NO: 490 - protein, 9 aa, Homo sapiens
RRRQLRSAP

SEQ ID NO: 491 - protein, 9 aa, Homo sapiens
LRQRRRQLR

SEQ ID NO: 492 - protein, 9 aa, Homo sapiens
QRLLRQRRR

SEQ ID NO: 493 - protein, 9 aa, Homo sapiens
GQRLLRQRR

SEQ ID NO: 494 - protein, 9 aa, Homo sapiens
IKPKSFKVN

SEQ ID NO: 495 - protein, 9 aa, Homo sapiens
EPAKMNFSY

SEQ ID NO: 496 - protein, 9 aa, Homo sapiens
VGKRRCIGE

SEQ ID NO: 497 - protein, 9 aa, Homo sapiens
WSVNHDPLK

SEQ ID NO: 498 - protein, 9 aa, Homo sapiens
VFVNQWSVN

SEQ ID NO: 499 - protein, 9 aa, Homo sapiens
PKDTVVFVN

SEQ ID NO: 500 - protein, 9 aa, Homo sapiens
TRVQAELDQ

SEQ ID NO: 501 - protein, 9 aa, Homo sapiens
AEKKAAGDS

SEQ ID NO: 502 - protein, 9 aa, Homo sapiens
RNFSNFILD

SEQ ID NO: 503 - protein, 9 aa, Homo sapiens
EQLNRNFSN

SEQ ID NO: 504 - protein, 9 aa, Homo sapiens
VRTVFREFE

SEQ ID NO: 505 - protein, 9 aa, Homo sapiens
PNPVRTVFR

SEQ ID NO: 506 - protein, 9 aa, Homo sapiens
PWLQYFPNP

SEQ ID NO: 507 - protein, 9 aa, Homo sapiens
MPWLQYFPN

SEQ ID NO: 508 - protein, 9 aa, Homo sapiens
CRYSHDDPE

SEQ ID NO: 509 - protein, 9 aa, Homo sapiens
HYSEHWKVQ

SEQ ID NO: 510 - protein, 9 aa, Homo sapiens
FGHYSEHWK

SEQ ID NO: 511 - protein, 9 aa, Homo sapiens
GRSMAFGHY

SEQ ID NO: 512 - protein, 9 aa, Homo sapiens
FRVVSGGRS

SEQ ID NO: 513 - protein, 9 aa, Homo sapiens
QGSAFADRP

SEQ ID NO: 514 - protein, 9 aa, Homo sapiens
RYGDVFQIR

SEQ ID NO: 515 - protein, 9 aa, Homo sapiens
RQRRRQLRS

SEQ ID NO: 516 - protein, 9 aa, Homo sapiens
MGTSLSPND

SEQ ID NO: 517 - protein, 9 aa, Homo sapiens
PENFDPARF

SEQ ID NO: 518 - protein, 9 aa, Homo sapiens
EGHVLSEAR

SEQ ID NO: 519 - protein, 9 aa, Homo sapiens
PNEPAKMNF

SEQ ID NO: 520 - protein, 9 aa, Homo sapiens
PYVLAFLYE

SEQ ID NO: 521 - protein, 9 aa, Homo sapiens
EKKAAGDSH

SEQ ID NO: 522 - protein, 9 aa, Homo sapiens
DPEFRELLS

SEQ ID NO: 523 - protein, 9 aa, Homo sapiens
EFEQLNRNF

SEQ ID NO: 524 - protein, 10 aa, Homo sapiens
LLLLSVLATV

SEQ ID NO: 525 - protein, 10 aa, Homo sapiens
FLDPRPLTVV

SEQ ID NO: 526 - protein, 10 aa, Homo sapiens
RLGSCPIVVL

SEQ ID NO: 527 - protein, 10 aa, Homo sapiens
SIQQTTLLLL

SEQ ID NO: 528 - protein, 10 aa, Homo sapiens
ELLDSAVQNL

SEQ ID NO: 529 - protein, 10 aa, Homo sapiens
HIPKDTVVFV

SEQ ID NO: 530 - protein, 10 aa, Homo sapiens
LLLFTRYPDV

SEQ ID NO: 531 - protein, 10 aa, Homo sapiens
LLSVLATVHV

SEQ ID NO: 532 - protein, 10 aa, Homo sapiens
LLLLLSVLAT

SEQ ID NO: 533 - protein, 10 aa, Homo sapiens
SLSPNDPWPL

SEQ ID NO: 534 - protein, 10 aa, Homo sapiens
STALQWLLLL

SEQ ID NO: 535 - protein, 10 aa, Homo sapiens
LTSRVMIFSV

SEQ ID NO: 536 - protein, 10 aa, Homo sapiens
DIFGASQDTL

SEQ ID NO: 537 - protein, 10 aa, Homo sapiens
PLTVVAVANV

SEQ ID NO: 538 - protein, 10 aa, Homo sapiens
VLEGHVLSEA

SEQ ID NO: 539 - protein, 10 aa, Homo sapiens
RLLRQRRRQL

SEQ ID NO: 540 - protein, 10 aa, Homo sapiens
LINKDLTSRV

SEQ ID NO: 541 - protein, 10 aa, Homo sapiens
AMRFSSFVPV

SEQ ID NO: 542 - protein, 10 aa, Homo sapiens
ALQWLLLLFT

SEQ ID NO: 543 - protein, 10 aa, Homo sapiens
LTIKPKSFKV

SEQ ID NO: 544 - protein, 10 aa, Homo sapiens
KMNFSYGLTI

SEQ ID NO: 545 - protein, 10 aa, Homo sapiens
TLSTALQWLL

SEQ ID NO: 546 - protein, 10 aa, Homo sapiens
RLDLENVPAT

SEQ ID NO: 547 - protein, 10 aa, Homo sapiens
DMMDAFILSA

SEQ ID NO: 548 - protein, 10 aa, Homo sapiens
QLNRNFSNFI

SEQ ID NO: 549 - protein, 10 aa, Homo sapiens
TVGAGSLVDV

SEQ ID NO: 550 - protein, 10 aa, Homo sapiens
SEARELVALL

SEQ ID NO: 551 - protein, 10 aa, Homo sapiens
AAAVGQAAHL

SEQ ID NO: 552 - protein, 10 aa, Homo sapiens
TTLLLLLSVL

SEQ ID NO: 553 - protein, 10 aa, Homo sapiens
QTTLLLLLSV

SEQ ID NO: 554 - protein, 10 aa, Homo sapiens
KMQLFLFISI

SEQ ID NO: 555 - protein, 10 aa, Homo sapiens
GLINKDLTSR

SEQ ID NO: 556 - protein, 10 aa, Homo sapiens
DTLSTALQWL

SEQ ID NO: 557 - protein, 10 aa, Homo sapiens
QYFPNPVRTV

SEQ ID NO: 558 - protein, 10 aa, Homo sapiens
QIRLGSCPIV

SEQ ID NO: 559 - protein, 10 aa, Homo sapiens
ILAHQCDFRA

SEQ ID NO: 560 - protein, 10 aa, Homo sapiens
FLFISILAHQ

SEQ ID NO: 561 - protein, 10 aa, Homo sapiens
LDLENVPATI

SEQ ID NO: 562 - protein, 10 aa, Homo sapiens
DPRPLTVVAV

SEQ ID NO: 563 - protein, 10 aa, Homo sapiens
AFLDPRPLTV

SEQ ID NO: 564 - protein, 10 aa, Homo sapiens
LSEARELVAL

SEQ ID NO: 565 - protein, 10 aa, Homo sapiens
VLSEARELVA

SEQ ID NO: 566 - protein, 10 aa, Homo sapiens
ALVQQGSAFA

SEQ ID NO: 567 - protein, 10 aa, Homo sapiens
QAAHLSFARL

SEQ ID NO: 568 - protein, 10 aa, Homo sapiens
TLLLLLSVLA

SEQ ID NO: 569 - protein, 10 aa, Homo sapiens
PLNPLSIQQT

SEQ ID NO: 570 - protein, 10 aa, Homo sapiens
VTLRESMELL

SEQ ID NO: 571 - protein, 10 aa, Homo sapiens
SVLGYHIPKD

SEQ ID NO: 572 - protein, 10 aa, Homo sapiens
PNLPYVLAFL

SEQ ID NO: 573 - protein, 10 aa, Homo sapiens
DVQTRVQAEL

SEQ ID NO: 574 - protein, 10 aa, Homo sapiens
GGARLDLENV

SEQ ID NO: 575 - protein, 10 aa, Homo sapiens
SHNEEFGRTV

SEQ ID NO: 576 - protein, 10 aa, Homo sapiens
VVAVANVMSA

SEQ ID NO: 577 - protein, 10 aa, Homo sapiens
LLVRGSADGA

SEQ ID NO: 578 - protein, 10 aa, Homo sapiens
VLATVHVGQR

SEQ ID NO: 579 - protein, 10 aa, Homo sapiens
IQQTTLLLLL

SEQ ID NO: 580 - protein, 10 aa, Homo sapiens
PLSIQQTTLL

SEQ ID NO: 581 - protein, 10 aa, Homo sapiens
FLYEAMRFSS

SEQ ID NO: 582 - protein, 10 aa, Homo sapiens
FILDKFLRHC

SEQ ID NO: 583 - protein, 10 aa, Homo sapiens
VAVANVMSAV

SEQ ID NO: 584 - protein, 10 aa, Homo sapiens
ALLVRGSADG

SEQ ID NO: 585 - protein, 10 aa, Homo sapiens
HVLSEARELV

SEQ ID NO: 586 - protein, 10 aa, Homo sapiens
IRLGSCPIVV

SEQ ID NO: 587 - protein, 10 aa, Homo sapiens
ATVHVGQRLL

SEQ ID NO: 588 - protein, 10 aa, Homo sapiens
NVTLRESMEL

SEQ ID NO: 589 - protein, 10 aa, Homo sapiens
RANPNEPAKM

SEQ ID NO: 590 - protein, 10 aa, Homo sapiens
QLFLFISILA

SEQ ID NO: 591 - protein, 10 aa, Homo sapiens
MQLFLFISIL

SEQ ID NO: 592 - protein, 10 aa, Homo sapiens
FLDKDGLINK

SEQ ID NO: 593 - protein, 10 aa, Homo sapiens
TVVFVNQWSV

SEQ ID NO: 594 - protein, 10 aa, Homo sapiens
LGYHIPKDTV

SEQ ID NO: 595 - protein, 10 aa, Homo sapiens
MGDQPNLPYV

SEQ ID NO: 596 - protein, 10 aa, Homo sapiens
LLLLFTRYPD

SEQ ID NO: 597 - protein, 10 aa, Homo sapiens
GASQDTLSTA

SEQ ID NO: 598 - protein, 10 aa, Homo sapiens
SHGGGARLDL

SEQ ID NO: 599 - protein, 10 aa, Homo sapiens
ILSAEKKAAG

SEQ ID NO: 600 - protein, 10 aa, Homo sapiens
FILSAEKKAA

SEQ ID NO: 601 - protein, 10 aa, Homo sapiens
SLRPGAAPRD

SEQ ID NO: 602 - protein, 10 aa, Homo sapiens
SHDDPEFREL

SEQ ID NO: 603 - protein, 10 aa, Homo sapiens
QVLEGHVLSE

SEQ ID NO: 604 - protein, 10 aa, Homo sapiens
FTRQPRSRQV

SEQ ID NO: 605 - protein, 10 aa, Homo sapiens
IVVLNGERAI

SEQ ID NO: 606 - protein, 10 aa, Homo sapiens
HLSFARLARR

SEQ ID NO: 607 - protein, 10 aa, Homo sapiens
WPLIGNAAAV

SEQ ID NO: 608 - protein, 10 aa, Homo sapiens
LATVHVGQRL

SEQ ID NO: 609 - protein, 10 aa, Homo sapiens
LSIQQTTLLL

SEQ ID NO: 610 - protein, 10 aa, Homo sapiens
IKPKSFKVNV

SEQ ID NO: 611 - protein, 10 aa, Homo sapiens
RCIGEELSKM

SEQ ID NO: 612 - protein, 10 aa, Homo sapiens
TIPHATTANT

SEQ ID NO: 613 - protein, 10 aa, Homo sapiens
YEAMRFSSFV

SEQ ID NO: 614 - protein, 10 aa, Homo sapiens
VLAFLYEAMR

SEQ ID NO: 615 - protein, 10 aa, Homo sapiens
GDQPNLPYVL

SEQ ID NO: 616 - protein, 10 aa, Homo sapiens
VVGRDRLPCM

SEQ ID NO: 617 - protein, 10 aa, Homo sapiens
RVQAELDQVV

SEQ ID NO: 618 - protein, 10 aa, Homo sapiens
TRVQAELDQV

SEQ ID NO: 619 - protein, 10 aa, Homo sapiens
ASQDTLSTAL

SEQ ID NO: 620 - protein, 10 aa, Homo sapiens
GSLVDVMPWL

SEQ ID NO: 621 - protein, 10 aa, Homo sapiens
LVALLVRGSA

SEQ ID NO: 622 - protein, 10 aa, Homo sapiens
EARELVALLV

SEQ ID NO: 623 - protein, 10 aa, Homo sapiens
AIHQALVQQG

SEQ ID NO: 624 - protein, 10 aa, Homo sapiens
VLNGERAIHQ

SEQ ID NO: 625 - protein, 10 aa, Homo sapiens
ARLARRYGDV

SEQ ID NO: 626 - protein, 10 aa, Homo sapiens
FAWPLIGNAA

SEQ ID NO: 627 - protein, 10 aa, Homo sapiens
APPGPFAWPL

SEQ ID NO: 628 - protein, 10 aa, Homo sapiens
LLLSVLATVH

SEQ ID NO: 629 - protein, 10 aa, Homo sapiens
NPLSIQQTTL

SEQ ID NO: 630 - protein, 10 aa, Homo sapiens
PNDPWPLNPL

SEQ ID NO: 631 - protein, 10 aa, Homo sapiens
LLDSAVQNLQ

SEQ ID NO: 632 - protein, 10 aa, Homo sapiens
TLRESMELLD

SEQ ID NO: 633 - protein, 10 aa, Homo sapiens
IGEELSKMQL

SEQ ID NO: 634 - protein, 10 aa, Homo sapiens
GKRRCIGEEL

SEQ ID NO: 635 - protein, 10 aa, Homo sapiens
VLGYHIPKDT

SEQ ID NO: 636 - protein, 10 aa, Homo sapiens
HATTANTSVL

SEQ ID NO: 637 - protein, 10 aa, Homo sapiens
SFVPVTIPHA

SEQ ID NO: 638 - protein, 10 aa, Homo sapiens
YVLAFLYEAM

SEQ ID NO: 639 - protein, 10 aa, Homo sapiens
LPCMGDQPNL

SEQ ID NO: 640 - protein, 10 aa, Homo sapiens
TRYPDVQTRV

SEQ ID NO: 641 - protein, 10 aa, Homo sapiens
LLFTRYPDVQ

SEQ ID NO: 642 - protein, 10 aa, Homo sapiens
GDSHGGGARL

SEQ ID NO: 643 - protein, 10 aa, Homo sapiens
MMDAFILSAE

SEQ ID NO: 644 - protein, 10 aa, Homo sapiens
APRDMMDAFI

SEQ ID NO: 645 - protein, 10 aa, Homo sapiens
GAAPRDMMDA

SEQ ID NO: 646 - protein, 10 aa, Homo sapiens
ILDKFLRHCE

SEQ ID NO: 647 - protein, 10 aa, Homo sapiens
RTVFREFEQL

SEQ ID NO: 648 - protein, 10 aa, Homo sapiens
SLVDVMPWLQ

SEQ ID NO: 649 - protein, 10 aa, Homo sapiens
VGAGSLVDVM

SEQ ID NO: 650 - protein, 10 aa, Homo sapiens
FGRTVGAGSL

SEQ ID NO: 651 - protein, 10 aa, Homo sapiens
LLSHNEEFGR

SEQ ID NO: 652 - protein, 10 aa, Homo sapiens
VRGSADGAFL

SEQ ID NO: 653 - protein, 10 aa, Homo sapiens
GHVLSEAREL

SEQ ID NO: 654 - protein, 10 aa, Homo sapiens
SRQVLEGHVL

SEQ ID NO: 655 - protein, 10 aa, Homo sapiens
SMAFGHYSEH

SEQ ID NO: 656 - protein, 10 aa, Homo sapiens
SAFADRPAFA

SEQ ID NO: 657 - protein, 10 aa, Homo sapiens
GERAIHQALV

SEQ ID NO: 658 - protein, 10 aa, Homo sapiens
LNGERAIHQA

SEQ ID NO: 659 - protein, 10 aa, Homo sapiens
ARRYGDVFQI

SEQ ID NO: 660 - protein, 10 aa, Homo sapiens
LIGNAAAVGQ

SEQ ID NO: 661 - protein, 10 aa, Homo sapiens
PLIGNAAAVG

SEQ ID NO: 662 - protein, 10 aa, Homo sapiens
DPWPLNPLSI

SEQ ID NO: 663 - protein, 10 aa, Homo sapiens
KVNVTLRESM

SEQ ID NO: 664 - protein, 10 aa, Homo sapiens
PAKMNFSYGL

SEQ ID NO: 665 - protein, 10 aa, Homo sapiens
SILAHQCDFR

SEQ ID NO: 666 - protein, 10 aa, Homo sapiens
TTANTSVLGY

SEQ ID NO: 667 - protein, 10 aa, Homo sapiens
RFSSFVPVTI

SEQ ID NO: 668 - protein, 10 aa, Homo sapiens
LDQVVGRDRL

SEQ ID NO: 669 - protein, 10 aa, Homo sapiens
WLLLLFTRYP

SEQ ID NO: 670 - protein, 10 aa, Homo sapiens
LSTALQWLLL

SEQ ID NO: 671 - protein, 10 aa, Homo sapiens
TITDIFGASQ

SEQ ID NO: 672 - protein, 10 aa, Homo sapiens
DLENVPATIT

SEQ ID NO: 673 - protein, 10 aa, Homo sapiens
AAGDSHGGGA

SEQ ID NO: 674 - protein, 10 aa, Homo sapiens
FLRHCESLRP

SEQ ID NO: 675 - protein, 10 aa, Homo sapiens
DKFLRHCESL

SEQ ID NO: 676 - protein, 10 aa, Homo sapiens
LNRNFSNFIL

SEQ ID NO: 677 - protein, 10 aa, Homo sapiens
HDDPEFRELL

SEQ ID NO: 678 - protein, 10 aa, Homo sapiens
SADGAFLDPR

SEQ ID NO: 679 - protein, 10 aa, Homo sapiens
ELVALLVRGS

SEQ ID NO: 680 - protein, 10 aa, Homo sapiens
TRQPRSRQVL

SEQ ID NO: 681 - protein, 10 aa, Homo sapiens
KVQRRAAHSM

SEQ ID NO: 682 - protein, 10 aa, Homo sapiens
FGHYSEHWKV

SEQ ID NO: 683 - protein, 10 aa, Homo sapiens
AFASFRVVSG

SEQ ID NO: 684 - protein, 10 aa, Homo sapiens
RAIHQALVQQ

SEQ ID NO: 685 - protein, 10 aa, Homo sapiens
RLARRYGDVF

SEQ ID NO: 686 - protein, 10 aa, Homo sapiens
LLRQRRRQLR

SEQ ID NO: 687 - protein, 10 aa, Homo sapiens
AVQNLQAKET

SEQ ID NO: 688 - protein, 10 aa, Homo sapiens
SMELLDSAVQ

SEQ ID NO: 689 - protein, 10 aa, Homo sapiens
ESMELLDSAV

SEQ ID NO: 690 - protein, 10 aa, Homo sapiens
ELSKMQLFLF

SEQ ID NO: 691 - protein, 10 aa, Homo sapiens
RVMIFSVGKR

SEQ ID NO: 692 - protein, 10 aa, Homo sapiens
ARFLDKDGLI

SEQ ID NO: 693 - protein, 10 aa, Homo sapiens
PARFLDKDGL

SEQ ID NO: 694 - protein, 10 aa, Homo sapiens
NQWSVNHDPL

SEQ ID NO: 695 - protein, 10 aa, Homo sapiens
FVNQWSVNHD

SEQ ID NO: 696 - protein, 10 aa, Homo sapiens
GYHIPKDTVV

SEQ ID NO: 697 - protein, 10 aa, Homo sapiens
PHATTANTSV

SEQ ID NO: 698 - protein, 10 aa, Homo sapiens
FVPVTIPHAT

SEQ ID NO: 699 - protein, 10 aa, Homo sapiens
TALQWLLLLF

SEQ ID NO: 700 - protein, 10 aa, Homo sapiens
ENVPATITDI

SEQ ID NO: 701 - protein, 10 aa, Homo sapiens
ARLDLENVPA

SEQ ID NO: 702 - protein, 10 aa, Homo sapiens
LTVVAVANVM

SEQ ID NO: 703 - protein, 10 aa, Homo sapiens
GAFLDPRPLT

SEQ ID NO: 704 - protein, 10 aa, Homo sapiens
SMMRNFFTRQ

SEQ ID NO: 705 - protein, 10 aa, Homo sapiens
RPAFASFRVV

SEQ ID NO: 706 - protein, 10 aa, Homo sapiens
FQIRLGSCPI

SEQ ID NO: 707 - protein, 10 aa, Homo sapiens
RYGDVFQIRL

SEQ ID NO: 708 - protein, 10 aa, Homo sapiens
IGNAAAVGQA

SEQ ID NO: 709 - protein, 10 aa, Homo sapiens
SVLATVHVGQ

SEQ ID NO: 710 - protein, 10 aa, Homo sapiens
SAVQNLQAKE

SEQ ID NO: 711 - protein, 10 aa, Homo sapiens
RESMELLDSA

SEQ ID NO: 712 - protein, 10 aa, Homo sapiens
PKSFKVNVTL

SEQ ID NO: 713 - protein, 10 aa, Homo sapiens
GLTIKPKSFK

SEQ ID NO: 714 - protein, 10 aa, Homo sapiens
LSKMQLFLFI

SEQ ID NO: 715 - protein, 10 aa, Homo sapiens
EELSKMQLFL

SEQ ID NO: 716 - protein, 10 aa, Homo sapiens
IFSVGKRRCI

SEQ ID NO: 717 - protein, 10 aa, Homo sapiens
NKDLTSRVMI

SEQ ID NO: 718 - protein, 10 aa, Homo sapiens
DKDGLINKDL

SEQ ID NO: 719 - protein, 10 aa, Homo sapiens
SVNHDPLKWP

SEQ ID NO: 720 - protein, 10 aa, Homo sapiens
ANTSVLGYHI

SEQ ID NO: 721 - protein, 10 aa, Homo sapiens
VTIPHATTAN

SEQ ID NO: 722 - protein, 10 aa, Homo sapiens
MRFSSFVPVT

SEQ ID NO: 723 - protein, 10 aa, Homo sapiens
CMGDQPNLPY

SEQ ID NO: 724 - protein, 10 aa, Homo sapiens
RLPCMGDQPN

SEQ ID NO: 725 - protein, 10 aa, Homo sapiens
QAELDQVVGR

SEQ ID NO: 726 - protein, 10 aa, Homo sapiens
FTRYPDVQTR

SEQ ID NO: 727 - protein, 10 aa, Homo sapiens
FGASQDTLST

SEQ ID NO: 728 - protein, 10 aa, Homo sapiens
KAAGDSHGGG

SEQ ID NO: 729 - protein, 10 aa, Homo sapiens
FSNFILDKFL

SEQ ID NO: 730 - protein, 10 aa, Homo sapiens
WLQYFPNPVR

SEQ ID NO: 731 - protein, 10 aa, Homo sapiens
PWLQYFPNPV

SEQ ID NO: 732 - protein, 10 aa, Homo sapiens
GRTVGAGSLV

SEQ ID NO: 733 - protein, 10 aa, Homo sapiens
AVANVMSAVC

SEQ ID NO: 734 - protein, 10 aa, Homo sapiens
DGAFLDPRPL

SEQ ID NO: 735 - protein, 10 aa, Homo sapiens
RSRQVLEGHV

SEQ ID NO: 736 - protein, 10 aa, Homo sapiens
NGERAIHQAL

SEQ ID NO: 737 - protein, 10 aa, Homo sapiens
DVFQIRLGSC

SEQ ID NO: 738 - protein, 10 aa, Homo sapiens
AAHLSFARLA

SEQ ID NO: 739 - protein, 10 aa, Homo sapiens
SAPPGPFAWP

SEQ ID NO: 740 - protein, 10 aa, Homo sapiens
QLRSAPPGPF

SEQ ID NO: 741 - protein, 10 aa, Homo sapiens
RQRRRQLRSA

SEQ ID NO: 742 - protein, 10 aa, Homo sapiens
KPKSFKVNVT

SEQ ID NO: 743 - protein, 10 aa, Homo sapiens
FISILAHQCD

SEQ ID NO: 744 - protein, 10 aa, Homo sapiens
LFLFISILAH

SEQ ID NO: 745 - protein, 10 aa, Homo sapiens
CIGEELSKMQ

SEQ ID NO: 746 - protein, 10 aa, Homo sapiens
MIFSVGKRRC

SEQ ID NO: 747 - protein, 10 aa, Homo sapiens
VMIFSVGKRR

SEQ ID NO: 748 - protein, 10 aa, Homo sapiens
LDKDGLINKD

SEQ ID NO: 749 - protein, 10 aa, Homo sapiens
TANTSVLGYH

SEQ ID NO: 750 - protein, 10 aa, Homo sapiens
VPVTIPHATT

SEQ ID NO: 751 - protein, 10 aa, Homo sapiens
NLPYVLAFLY

SEQ ID NO: 752 - protein, 10 aa, Homo sapiens
AELDQVVGRD

SEQ ID NO: 753 - protein, 10 aa, Homo sapiens
LQWLLLLFTR

SEQ ID NO: 754 - protein, 10 aa, Homo sapiens
ATITDIFGAS

SEQ ID NO: 755 - protein, 10 aa, Homo sapiens
PATITDIFGA

SEQ ID NO: 756 - protein, 10 aa, Homo sapiens
LSAEKKAAGD

SEQ ID NO: 757 - protein, 10 aa, Homo sapiens
AFILSAEKKA

SEQ ID NO: 758 - protein, 10 aa, Homo sapiens
VMPWLQYFPN

SEQ ID NO: 759 - protein, 10 aa, Homo sapiens
ELLSHNEEFG

SEQ ID NO: 760 - protein, 10 aa, Homo sapiens
VMSAVCFGCR

SEQ ID NO: 761 - protein, 10 aa, Homo sapiens
LVRGSADGAF

SEQ ID NO: 762 - protein, 10 aa, Homo sapiens
FASFRVVSGG

SEQ ID NO: 763 - protein, 10 aa, Homo sapiens
DRPAFASFRV

SEQ ID NO: 764 - protein, 10 aa, Homo sapiens
FADRPAFASF

SEQ ID NO: 765 - protein, 10 aa, Homo sapiens
VVLNGERAIH

SEQ ID NO: 766 - protein, 10 aa, Homo sapiens
PIVVLNGERA

SEQ ID NO: 767 - protein, 10 aa, Homo sapiens
VGQAAHLSFA

SEQ ID NO: 768 - protein, 10 aa, Homo sapiens
AVGQAAHLSF

SEQ ID NO: 769 - protein, 10 aa, Homo sapiens
AAVGQAAHLS

SEQ ID NO: 770 - protein, 10 aa, Homo sapiens
NAAAVGQAAH

SEQ ID NO: 771 - protein, 10 aa, Homo sapiens
AWPLIGNAAA

SEQ ID NO: 772 - protein, 10 aa, Homo sapiens
TIKPKSFKVN

SEQ ID NO: 773 - protein, 10 aa, Homo sapiens
DLTSRVMIFS

SEQ ID NO: 774 - protein, 10 aa, Homo sapiens
YHIPKDTVVF

SEQ ID NO: 775 - protein, 10 aa, Homo sapiens
PYVLAFLYEA

SEQ ID NO: 776 - protein, 10 aa, Homo sapiens
YPDVQTRVQA

SEQ ID NO: 777 - protein, 10 aa, Homo sapiens
LRPGAAPRDM

SEQ ID NO: 778 - protein, 10 aa, Homo sapiens
RHCESLRPGA

SEQ ID NO: 779 - protein, 10 aa, Homo sapiens
LQYFPNPVRT

SEQ ID NO: 780 - protein, 10 aa, Homo sapiens
AVCFGCRYSH

SEQ ID NO: 781 - protein, 10 aa, Homo sapiens
VANVMSAVCF

SEQ ID NO: 782 - protein, 10 aa, Homo sapiens
LDPRPLTVVA

SEQ ID NO: 783 - protein, 10 aa, Homo sapiens
VALLVRGSAD

SEQ ID NO: 784 - protein, 10 aa, Homo sapiens
RELVALLVRG

SEQ ID NO: 785 - protein, 10 aa, Homo sapiens
MMRNFFTRQP

SEQ ID NO: 786 - protein, 10 aa, Homo sapiens
VVSGGRSMAF

SEQ ID NO: 787 - protein, 10 aa, Homo sapiens
RVVSGGRSMA

SEQ ID NO: 788 - protein, 10 aa, Homo sapiens
HQALVQQGSA

SEQ ID NO: 789 - protein, 10 aa, Homo sapiens
SCPIVVLNGE

SEQ ID NO: 790 - protein, 10 aa, Homo sapiens
GSCPIVVLNG

SEQ ID NO: 791 - protein, 10 aa, Homo sapiens
LGSCPIVVLN

SEQ ID NO: 792 - protein, 10 aa, Homo sapiens
LARRYGDVFQ

SEQ ID NO: 793 - protein, 10 aa, Homo sapiens
GNAAAVGQAA

SEQ ID NO: 794 - protein, 10 aa, Homo sapiens
PPGPFAWPLI

SEQ ID NO: 795 - protein, 10 aa, Homo sapiens
HVGQRLLRQR

SEQ ID NO: 796 - protein, 10 aa, Homo sapiens
VHVGQRLLRQ

SEQ ID NO: 797 - protein, 10 aa, Homo sapiens
LNPLSIQQTT

SEQ ID NO: 798 - protein, 10 aa, Homo sapiens
LDSAVQNLQA

SEQ ID NO: 799 - protein, 10 aa, Homo sapiens
FKVNVTLRES

SEQ ID NO: 800 - protein, 10 aa, Homo sapiens
FSYGLTIKPK

SEQ ID NO: 801 - protein, 10 aa, Homo sapiens
AKMNFSYGLT

SEQ ID NO: 802 - protein, 10 aa, Homo sapiens
LAHQCDFRAN

SEQ ID NO: 803 - protein, 10 aa, Homo sapiens
SKMQLFLFIS

SEQ ID NO: 804 - protein, 10 aa, Homo sapiens
SVGKRRCIGE

SEQ ID NO: 805 - protein, 10 aa, Homo sapiens
KDLTSRVMIF

SEQ ID NO: 806 - protein, 10 aa, Homo sapiens
FDPARFLDKD

SEQ ID NO: 807 - protein, 10 aa, Homo sapiens
PENFDPARFL

SEQ ID NO: 808 - protein, 10 aa, Homo sapiens
WPNPENFDPA

SEQ ID NO: 809 - protein, 10 aa, Homo sapiens
ATTANTSVLG

SEQ ID NO: 810 - protein, 10 aa, Homo sapiens
LAFLYEAMRF

SEQ ID NO: 811 - protein, 10 aa, Homo sapiens
QPNLPYVLAF

SEQ ID NO: 812 - protein, 10 aa, Homo sapiens
QVVGRDRLPC

SEQ ID NO: 813 - protein, 10 aa, Homo sapiens
ELDQVVGRDR

SEQ ID NO: 814 - protein, 10 aa, Homo sapiens
VQAELDQVVG

SEQ ID NO: 815 - protein, 10 aa, Homo sapiens
LFTRYPDVQT

SEQ ID NO: 816 - protein, 10 aa, Homo sapiens
PRDMMDAFIL

SEQ ID NO: 817 - protein, 10 aa, Homo sapiens
AAPRDMMDAF

SEQ ID NO: 818 - protein, 10 aa, Homo sapiens
DVMPWLQYFP

SEQ ID NO: 819 - protein, 10 aa, Homo sapiens
LVDVMPWLQY

SEQ ID NO: 820 - protein, 10 aa, Homo sapiens
GAGSLVDVMP

SEQ ID NO: 821 - protein, 10 aa, Homo sapiens
RTVGAGSLVD

SEQ ID NO: 822 - protein, 10 aa, Homo sapiens
PRPLTVVAVA

SEQ ID NO: 823 - protein, 10 aa, Homo sapiens
QPRSRQVLEG

SEQ ID NO: 824 - protein, 10 aa, Homo sapiens
AAHSMMRNFF

SEQ ID NO: 825 - protein, 10 aa, Homo sapiens
MAFGHYSEHW

SEQ ID NO: 826 - protein, 10 aa, Homo sapiens
FRVVSGGRSM

SEQ ID NO: 827 - protein, 10 aa, Homo sapiens
LVQQGSAFAD

SEQ ID NO: 828 - protein, 10 aa, Homo sapiens
QALVQQGSAF

SEQ ID NO: 829 - protein, 10 aa, Homo sapiens
FARLARRYGD

SEQ ID NO: 830 - protein, 10 aa, Homo sapiens
PFAWPLIGNA

SEQ ID NO: 831 - protein, 10 aa, Homo sapiens
GPFAWPLIGN

SEQ ID NO: 832 - protein, 10 aa, Homo sapiens
LRSAPPGPFA

SEQ ID NO: 833 - protein, 10 aa, Homo sapiens
LSVLATVHVG

SEQ ID NO: 834 - protein, 10 aa, Homo sapiens
DSAVQNLQAK

SEQ ID NO: 835 - protein, 10 aa, Homo sapiens
LRESMELLDS

SEQ ID NO: 836 - protein, 10 aa, Homo sapiens
KSFKVNVTLR

SEQ ID NO: 837 - protein, 10 aa, Homo sapiens
VGKRRCIGEE

SEQ ID NO: 838 - protein, 10 aa, Homo sapiens
INKDLTSRVM

SEQ ID NO: 839 - protein, 10 aa, Homo sapiens
LKWPNPENFD

SEQ ID NO: 840 - protein, 10 aa, Homo sapiens
PLKWPNPENF

SEQ ID NO: 841 - protein, 10 aa, Homo sapiens
VVFVNQWSVN

SEQ ID NO: 842 - protein, 10 aa, Homo sapiens
IPKDTVVFVN

SEQ ID NO: 843 - protein, 10 aa, Homo sapiens
PVTIPHATTA

SEQ ID NO: 844 - protein, 10 aa, Homo sapiens
ITDIFGASQD

SEQ ID NO: 845 - protein, 10 aa, Homo sapiens
GARLDLENVP

SEQ ID NO: 846 - protein, 10 aa, Homo sapiens
HGGGARLDLE

SEQ ID NO: 847 - protein, 10 aa, Homo sapiens
DAFILSAEKK

SEQ ID NO: 848 - protein, 10 aa, Homo sapiens
LRHCESLRPG

SEQ ID NO: 849 - protein, 10 aa, Homo sapiens
NFSNFILDKF

SEQ ID NO: 850 - protein, 10 aa, Homo sapiens
RNFSNFILDK

SEQ ID NO: 851 - protein, 10 aa, Homo sapiens
FPNPVRTVFR

SEQ ID NO: 852 - protein, 10 aa, Homo sapiens
AGSLVDVMPW

SEQ ID NO: 853 - protein, 10 aa, Homo sapiens
LSHNEEFGRT

SEQ ID NO: 854 - protein, 10 aa, Homo sapiens
SAVCFGCRYS

SEQ ID NO: 855 - protein, 10 aa, Homo sapiens
NVMSAVCFGC

SEQ ID NO: 856 - protein, 10 aa, Homo sapiens
ANVMSAVCFG

SEQ ID NO: 857 - protein, 10 aa, Homo sapiens
TVVAVANVMS

SEQ ID NO: 858 - protein, 10 aa, Homo sapiens
ARELVALLVR

SEQ ID NO: 859 - protein, 10 aa, Homo sapiens
AHSMMRNFFT

SEQ ID NO: 860 - protein, 10 aa, Homo sapiens
RAAHSMMRNF

SEQ ID NO: 861 - protein, 10 aa, Homo sapiens
SEHWKVQRRA

SEQ ID NO: 862 - protein, 10 aa, Homo sapiens
AFADRPAFAS

SEQ ID NO: 863 - protein, 10 aa, Homo sapiens
YGDVFQIRLG

SEQ ID NO: 864 - protein, 10 aa, Homo sapiens
AHLSFARLAR

SEQ ID NO: 865 - protein, 10 aa, Homo sapiens
YGLTIKPKSF

SEQ ID NO: 866 - protein, 10 aa, Homo sapiens
SYGLTIKPKS

SEQ ID NO: 867 - protein, 10 aa, Homo sapiens
MNFSYGLTIK

SEQ ID NO: 868 - protein, 10 aa, Homo sapiens
FRANPNEPAK

SEQ ID NO: 869 - protein, 10 aa, Homo sapiens
LFISILAHQC

SEQ ID NO: 870 - protein, 10 aa, Homo sapiens
SRVMIFSVGK

SEQ ID NO: 871 - protein, 10 aa, Homo sapiens
KDGLINKDLT

SEQ ID NO: 872 - protein, 10 aa, Homo sapiens
KDTVVFVNQW

SEQ ID NO: 873 - protein, 10 aa, Homo sapiens
NTSVLGYHIP

SEQ ID NO: 874 - protein, 10 aa, Homo sapiens
IPHATTANTS

SEQ ID NO: 875 - protein, 10 aa, Homo sapiens
DQPNLPYVLA

SEQ ID NO: 876 - protein, 10 aa, Homo sapiens
QTRVQAELDQ

SEQ ID NO: 877 - protein, 10 aa, Homo sapiens
TDIFGASQDT

SEQ ID NO: 878 - protein, 10 aa, Homo sapiens
LENVPATITD

SEQ ID NO: 879 - protein, 10 aa, Homo sapiens
KKAAGDSHGG

SEQ ID NO: 880 - protein, 10 aa, Homo sapiens
SAEKKAAGDS

SEQ ID NO: 881 - protein, 10 aa, Homo sapiens
MDAFILSAEK

SEQ ID NO: 882 - protein, 10 aa, Homo sapiens
TVFREFEQLN

SEQ ID NO: 883 - protein, 10 aa, Homo sapiens
VDVMPWLQYF

SEQ ID NO: 884 - protein, 10 aa, Homo sapiens
EEFGRTVGAG

SEQ ID NO: 885 - protein, 10 aa, Homo sapiens
NEEFGRTVGA

SEQ ID NO: 886 - protein, 10 aa, Homo sapiens
RPLTVVAVAN

SEQ ID NO: 887 - protein, 10 aa, Homo sapiens
GSADGAFLDP

SEQ ID NO: 888 - protein, 10 aa, Homo sapiens
VQRRAAHSMM

SEQ ID NO: 889 - protein, 10 aa, Homo sapiens
YSEHWKVQRR

SEQ ID NO: 890 - protein, 10 aa, Homo sapiens
VSGGRSMAFG

SEQ ID NO: 891 - protein, 10 aa, Homo sapiens
VQQGSAFADR

SEQ ID NO: 892 - protein, 10 aa, Homo sapiens
RSAPPGPFAW

SEQ ID NO: 893 - protein, 10 aa, Homo sapiens
TVHVGQRLLR

SEQ ID NO: 894 - protein, 10 aa, Homo sapiens
SPNDPWPLNP

SEQ ID NO: 895 - protein, 10 aa, Homo sapiens
GTSLSPNDPW

SEQ ID NO: 896 - protein, 10 aa, Homo sapiens
VQNLQAKETC

SEQ ID NO: 897 - protein, 10 aa, Homo sapiens
MELLDSAVQN

SEQ ID NO: 898 - protein, 10 aa, Homo sapiens
CDFRANPNEP

SEQ ID NO: 899 - protein, 10 aa, Homo sapiens
AHQCDFRANP

SEQ ID NO: 900 - protein, 10 aa, Homo sapiens
ISILAHQCDF

SEQ ID NO: 901 - protein, 10 aa, Homo sapiens
DGLINKDLTS

SEQ ID NO: 902 - protein, 10 aa, Homo sapiens
RFLDKDGLIN

SEQ ID NO: 903 - protein, 10 aa, Homo sapiens
DPLKWPNPEN

SEQ ID NO: 904 - protein, 10 aa, Homo sapiens
FSSFVPVTIP

SEQ ID NO: 905 - protein, 10 aa, Homo sapiens
LPYVLAFLYE

SEQ ID NO: 906 - protein, 10 aa, Homo sapiens
SQDTLSTALQ

SEQ ID NO: 907 - protein, 10 aa, Homo sapiens
NVPATITDIF

SEQ ID NO: 908 - protein, 10 aa, Homo sapiens
GGGARLDLEN

SEQ ID NO: 909 - protein, 10 aa, Homo sapiens
RPGAAPRDMM

SEQ ID NO: 910 - protein, 10 aa, Homo sapiens
HCESLRPGAA

SEQ ID NO: 911 - protein, 10 aa, Homo sapiens
FREFEQLNRN

SEQ ID NO: 912 - protein, 10 aa, Homo sapiens
VFREFEQLNR

SEQ ID NO: 913 - protein, 10 aa, Homo sapiens
RELLSHNEEF

SEQ ID NO: 914 - protein, 10 aa, Homo sapiens
DPEFRELLSH

SEQ ID NO: 915 - protein, 10 aa, Homo sapiens
CRYSHDDPEF

SEQ ID NO: 916 - protein, 10 aa, Homo sapiens
VCFGCRYSHD

SEQ ID NO: 917 - protein, 10 aa, Homo sapiens
HYSEHWKVQR

SEQ ID NO: 918 - protein, 10 aa, Homo sapiens
RSMAFGHYSE

SEQ ID NO: 919 - protein, 10 aa, Homo sapiens
ASFRVVSGGR

SEQ ID NO: 920 - protein, 10 aa, Homo sapiens
PAFASFRVVS

SEQ ID NO: 921 - protein, 10 aa, Homo sapiens
ADRPAFASFR

SEQ ID NO: 922 - protein, 10 aa, Homo sapiens
GSAFADRPAF

SEQ ID NO: 923 - protein, 10 aa, Homo sapiens
QGSAFADRPA

SEQ ID NO: 924 - protein, 10 aa, Homo sapiens
CPIVVLNGER

SEQ ID NO: 925 - protein, 10 aa, Homo sapiens
SFARLARRYG

SEQ ID NO: 926 - protein, 10 aa, Homo sapiens
GQAAHLSFAR

SEQ ID NO: 927 - protein, 10 aa, Homo sapiens
RQLRSAPPGP

SEQ ID NO: 928 - protein, 10 aa, Homo sapiens
QQTTLLLLLS

SEQ ID NO: 929 - protein, 10 aa, Homo sapiens
NPNEPAKMNF

SEQ ID NO: 930 - protein, 10 aa, Homo sapiens
DFRANPNEPA

SEQ ID NO: 931 - protein, 10 aa, Homo sapiens
RRCIGEELSK

SEQ ID NO: 932 - protein, 10 aa, Homo sapiens
FSVGKRRCIG

SEQ ID NO: 933 - protein, 10 aa, Homo sapiens
NFDPARFLDK

SEQ ID NO: 934 - protein, 10 aa, Homo sapiens
NHDPLKWPNP

SEQ ID NO: 935 - protein, 10 aa, Homo sapiens
WSVNHDPLKW

SEQ ID NO: 936 - protein, 10 aa, Homo sapiens
VFVNQWSVNH

SEQ ID NO: 937 - protein, 10 aa, Homo sapiens
DTVVFVNQWS

SEQ ID NO: 938 - protein, 10 aa, Homo sapiens
SSFVPVTIPH

SEQ ID NO: 939 - protein, 10 aa, Homo sapiens
LYEAMRFSSF

SEQ ID NO: 940 - protein, 10 aa, Homo sapiens
AFLYEAMRFS

SEQ ID NO: 941 - protein, 10 aa, Homo sapiens
DRLPCMGDQP

SEQ ID NO: 942 - protein, 10 aa, Homo sapiens
VPATITDIFG

SEQ ID NO: 943 - protein, 10 aa, Homo sapiens
AGDSHGGGAR

SEQ ID NO: 944 - protein, 10 aa, Homo sapiens
AEKKAAGDSH

SEQ ID NO: 945 - protein, 10 aa, Homo sapiens
CESLRPGAAP

SEQ ID NO: 946 - protein, 10 aa, Homo sapiens
KFLRHCESLR

SEQ ID NO: 947 - protein, 10 aa, Homo sapiens
NFILDKFLRH

SEQ ID NO: 948 - protein, 10 aa, Homo sapiens
SNFILDKFLR

SEQ ID NO: 949 - protein, 10 aa, Homo sapiens
FEQLNRNFSN

SEQ ID NO: 950 - protein, 10 aa, Homo sapiens
REFEQLNRNF

SEQ ID NO: 951 - protein, 10 aa, Homo sapiens
FRELLSHNEE

SEQ ID NO: 952 - protein, 10 aa, Homo sapiens
YSHDDPEFRE

SEQ ID NO: 953 - protein, 10 aa, Homo sapiens
ADGAFLDPRP

SEQ ID NO: 954 - protein, 10 aa, Homo sapiens
LEGHVLSEAR

SEQ ID NO: 955 - protein, 10 aa, Homo sapiens
NFFTRQPRSR

SEQ ID NO: 956 - protein, 10 aa, Homo sapiens
HSMMRNFFTR

SEQ ID NO: 957 - protein, 10 aa, Homo sapiens
EHWKVQRRAA

SEQ ID NO: 958 - protein, 10 aa, Homo sapiens
AFGHYSEHWK

SEQ ID NO: 959 - protein, 10 aa, Homo sapiens
SGGRSMAFGH

SEQ ID NO: 960 - protein, 10 aa, Homo sapiens
IHQALVQQGS

SEQ ID NO: 961 - protein, 10 aa, Homo sapiens
RRYGDVFQIR

SEQ ID NO: 962 - protein, 10 aa, Homo sapiens
LSFARLARRY

SEQ ID NO: 963 - protein, 10 aa, Homo sapiens
LRQRRRQLRS

SEQ ID NO: 964 - protein, 10 aa, Homo sapiens
LSPNDPWPLN

SEQ ID NO: 965 - protein, 10 aa, Homo sapiens
TSLSPNDPWP

SEQ ID NO: 966 - protein, 10 aa, Homo sapiens
QNLQAKETCQ

SEQ ID NO: 967 - protein, 10 aa, Homo sapiens
SFKVNVTLRE

SEQ ID NO: 968 - protein, 10 aa, Homo sapiens
NEPAKMNFSY

SEQ ID NO: 969 - protein, 10 aa, Homo sapiens
HQCDFRANPN

SEQ ID NO: 970 - protein, 10 aa, Homo sapiens
VNHDPLKWPN

SEQ ID NO: 971 - protein, 10 aa, Homo sapiens
VNQWSVNHDP

SEQ ID NO: 972 - protein, 10 aa, Homo sapiens
EAMRFSSFVP

SEQ ID NO: 973 - protein, 10 aa, Homo sapiens
GRDRLPCMGD

SEQ ID NO: 974 - protein, 10 aa, Homo sapiens
VGRDRLPCMG

SEQ ID NO: 975 - protein, 10 aa, Homo sapiens
PDVQTRVQAE

SEQ ID NO: 976 - protein, 10 aa, Homo sapiens
QWLLLLFTRY

SEQ ID NO: 977 - protein, 10 aa, Homo sapiens
IFGASQDTLS

SEQ ID NO: 978 - protein, 10 aa, Homo sapiens
LDKFLRHCES

SEQ ID NO: 979 - protein, 10 aa, Homo sapiens
VRTVFREFEQ

SEQ ID NO: 980 - protein, 10 aa, Homo sapiens
NPVRTVFREF

SEQ ID NO: 981 - protein, 10 aa, Homo sapiens
YFPNPVRTVF

SEQ ID NO: 982 - protein, 10 aa, Homo sapiens
MPWLQYFPNP

SEQ ID NO: 983 - protein, 10 aa, Homo sapiens
PEFRELLSHN

SEQ ID NO: 984 - protein, 10 aa, Homo sapiens
DDPEFRELLS

SEQ ID NO: 985 - protein, 10 aa, Homo sapiens
MSAVCFGCRY

SEQ ID NO: 986 - protein, 10 aa, Homo sapiens
RQVLEGHVLS

SEQ ID NO: 987 - protein, 10 aa, Homo sapiens
PRSRQVLEGH

SEQ ID NO: 988 - protein, 10 aa, Homo sapiens
RQPRSRQVLE

SEQ ID NO: 989 - protein, 10 aa, Homo sapiens
RRAAHSMMRN

SEQ ID NO: 990 - protein, 10 aa, Homo sapiens
WKVQRRAAHS

SEQ ID NO: 991 - protein, 10 aa, Homo sapiens
HWKVQRRAAH

SEQ ID NO: 992 - protein, 10 aa, Homo sapiens
GRSMAFGHYS

SEQ ID NO: 993 - protein, 10 aa, Homo sapiens
SFRVVSGGRS

SEQ ID NO: 994 - protein, 10 aa, Homo sapiens
GDVFQIRLGS

SEQ ID NO: 995 - protein, 10 aa, Homo sapiens
RRRQLRSAPP

SEQ ID NO: 996 - protein, 10 aa, Homo sapiens
QRLLRQRRRQ

SEQ ID NO: 997 - protein, 10 aa, Homo sapiens
WPLNPLSIQQ

SEQ ID NO: 998 - protein, 10 aa, Homo sapiens
VNVTLRESME

SEQ ID NO: 999 - protein, 10 aa, Homo sapiens
NFSYGLTIKP

SEQ ID NO: 1000 - protein, 10 aa, Homo sapiens
ANPNEPAKMN

SEQ ID NO: 1001 - protein, 10 aa, Homo sapiens
KRRCIGEELS

SEQ ID NO: 1002 - protein, 10 aa, Homo sapiens
NPENFDPARF

SEQ ID NO: 1003 - protein, 10 aa, Homo sapiens
PNPENFDPAR

SEQ ID NO: 1004 - protein, 10 aa, Homo sapiens
KWPNPENFDP

SEQ ID NO: 1005 - protein, 10 aa, Homo sapiens
HDPLKWPNPE

SEQ ID NO: 1006 - protein, 10 aa, Homo sapiens
QWSVNHDPLK

SEQ ID NO: 1007 - protein, 10 aa, Homo sapiens
PCMGDQPNLP

SEQ ID NO: 1008 - protein, 10 aa, Homo sapiens
RYPDVQTRVQ

SEQ ID NO: 1009 - protein, 10 aa, Homo sapiens
DSHGGGARLD

SEQ ID NO: 1010 - protein, 10 aa, Homo sapiens
RDMMDAFILS

SEQ ID NO: 1011 - protein, 10 aa, Homo sapiens
ESLRPGAAPR

SEQ ID NO: 1012 - protein, 10 aa, Homo sapiens
PVRTVFREFE

SEQ ID NO: 1013 - protein, 10 aa, Homo sapiens
PNPVRTVFRE

SEQ ID NO: 1014 - protein, 10 aa, Homo sapiens
HNEEFGRTVG

SEQ ID NO: 1015 - protein, 10 aa, Homo sapiens
FGCRYSHDDP

SEQ ID NO: 1016 - protein, 10 aa, Homo sapiens
CFGCRYSHDD

SEQ ID NO: 1017 - protein, 10 aa, Homo sapiens
RNFFTRQPRS

SEQ ID NO: 1018 - protein, 10 aa, Homo sapiens
GHYSEHWKVQ

SEQ ID NO: 1019 - protein, 10 aa, Homo sapiens
GGRSMAFGHY

SEQ ID NO: 1020 - protein, 10 aa, Homo sapiens
VFQIRLGSCP

SEQ ID NO: 1021 - protein, 10 aa, Homo sapiens
RRQLRSAPPG

SEQ ID NO: 1022 - protein, 10 aa, Homo sapiens
QRRRQLRSAP

SEQ ID NO: 1023 - protein, 10 aa, Homo sapiens
GQRLLRQRRR

SEQ ID NO: 1024 - protein, 10 aa, Homo sapiens
VGQRLLRQRR

SEQ ID NO: 1025 - protein, 10 aa, Homo sapiens
PWPLNPLSIQ

SEQ ID NO: 1026 - protein, 10 aa, Homo sapiens
NDPWPLNPLS

SEQ ID NO: 1027 - protein, 10 aa, Homo sapiens
EPAKMNFSYG

SEQ ID NO: 1028 - protein, 10 aa, Homo sapiens
PNEPAKMNFS

SEQ ID NO: 1029 - protein, 10 aa, Homo sapiens
ENFDPARFLD

SEQ ID NO: 1030 - protein, 10 aa, Homo sapiens
PKDTVVFVNQ

SEQ ID NO: 1031 - protein, 10 aa, Homo sapiens
DQVVGRDRLP

SEQ ID NO: 1032 - protein, 10 aa, Homo sapiens
PGAAPRDMMD

SEQ ID NO: 1033 - protein, 10 aa, Homo sapiens
EQLNRNFSNF

SEQ ID NO: 1034 - protein, 10 aa, Homo sapiens
EGHVLSEARE

SEQ ID NO: 1035 - protein, 10 aa, Homo sapiens
EFEQLNRNFS

SEQ ID NO: 1036 - protein, 10 aa, Homo sapiens
PGPFAWPLIG

SEQ ID NO: 1037 - protein, 10 aa, Homo sapiens
EKKAAGDSHG

SEQ ID NO: 1038 - protein, 8 aa, Homo sapiens
SAVQNLQA

SEQ ID NO: 1039 - protein, 8 aa, Homo sapiens
SMELLDSA

SEQ ID NO: 1040 - protein, 8 aa, Homo sapiens
RANPNEPA

SEQ ID NO: 1041 - protein, 8 aa, Homo sapiens
AHQCDFRA

SEQ ID NO: 1042 - protein, 8 aa, Homo sapiens
FLFISILA

SEQ ID NO: 1043 - protein, 8 aa, Homo sapiens
NPENFDPA

SEQ ID NO: 1044 - protein, 8 aa, Homo sapiens
TIPHATTA

SEQ ID NO: 1045 - protein, 8 aa, Homo sapiens
VPVTIPHA

SEQ ID NO: 1046 - protein, 8 aa, Homo sapiens
VLAFLYEA

SEQ ID NO: 1047 - protein, 8 aa, Homo sapiens
PNLPYVLA

SEQ ID NO: 1048 - protein, 8 aa, Homo sapiens
DVQTRVQA

SEQ ID NO: 1049 - protein, 8 aa, Homo sapiens
SQDTLSTA

SEQ ID NO: 1050 - protein, 8 aa, Homo sapiens
TITDIFGA

SEQ ID NO: 1051 - protein, 8 aa, Homo sapiens
LDLENVPA

SEQ ID NO: 1052 - protein, 8 aa, Homo sapiens
GDSHGGGA

SEQ ID NO: 1053 - protein, 8 aa, Homo sapiens
LSAEKKAA

SEQ ID NO: 1054 - protein, 8 aa, Homo sapiens
ILSAEKKA

SEQ ID NO: 1055 - protein, 8 aa, Homo sapiens
MDAFILSA

SEQ ID NO: 1056 - protein, 8 aa, Homo sapiens
APRDMMDA

SEQ ID NO: 1057 - protein, 8 aa, Homo sapiens
ESLRPGAA

SEQ ID NO: 1058 - protein, 8 aa, Homo sapiens
CESLRPGA

SEQ ID NO: 1059 - protein, 8 aa, Homo sapiens
EFGRTVGA

SEQ ID NO: 1060 - protein, 8 aa, Homo sapiens
AVANVMSA

SEQ ID NO: 1061 - protein, 8 aa, Homo sapiens
PLTVVAVA

SEQ ID NO: 1062 - protein, 8 aa, Homo sapiens
PRPLTVVA

SEQ ID NO: 1063 - protein, 8 aa, Homo sapiens
VRGSADGA

SEQ ID NO: 1064 - protein, 8 aa, Homo sapiens
ALLVRGSA

SEQ ID NO: 1065 - protein, 8 aa, Homo sapiens
SEARELVA

SEQ ID NO: 1066 - protein, 8 aa, Homo sapiens
EGHVLSEA

SEQ ID NO: 1067 - protein, 8 aa, Homo sapiens
WKVQRRAA

SEQ ID NO: 1068 - protein, 8 aa, Homo sapiens
HWKVQRRA

SEQ ID NO: 1069 - protein, 8 aa, Homo sapiens
VSGGRSMA

SEQ ID NO: 1070 - protein, 8 aa, Homo sapiens
FADRPAFA

SEQ ID NO: 1071 - protein, 8 aa, Homo sapiens
SAFADRPA

SEQ ID NO: 1072 - protein, 8 aa, Homo sapiens
VQQGSAFA

SEQ ID NO: 1073 - protein, 8 aa, Homo sapiens
ALVQQGSA

SEQ ID NO: 1074 - protein, 8 aa, Homo sapiens
GERAIHQA

SEQ ID NO: 1075 - protein, 8 aa, Homo sapiens
VVLNGERA

SEQ ID NO: 1076 - protein, 8 aa, Homo sapiens
HLSFARLA

SEQ ID NO: 1077 - protein, 8 aa, Homo sapiens
QAAHLSFA

SEQ ID NO: 1078 - protein, 8 aa, Homo sapiens
AAAVGQAA

SEQ ID NO: 1079 - protein, 8 aa, Homo sapiens
NAAAVGQA

SEQ ID NO: 1080 - protein, 8 aa, Homo sapiens
PLIGNAAA

SEQ ID NO: 1081 - protein, 8 aa, Homo sapiens
WPLIGNAA

SEQ ID NO: 1082 - protein, 8 aa, Homo sapiens
AWPLIGNA

SEQ ID NO: 1083 - protein, 8 aa, Homo sapiens
SAPPGPFA

SEQ ID NO: 1084 - protein, 8 aa, Homo sapiens
RRRQLRSA

SEQ ID NO: 1085 - protein, 8 aa, Homo sapiens
LLLLSVLA

SEQ ID NO: 1086 - protein, 9 aa, Homo sapiens
NLQAKETCQ

SEQ ID NO: 1087 - protein, 9 aa, Homo sapiens
LDSAVQNLQ

SEQ ID NO: 1088 - protein, 9 aa, Homo sapiens
NEPAKMNFS

SEQ ID NO: 1089 - protein, 9 aa, Homo sapiens
DFRANPNEP

SEQ ID NO: 1090 - protein, 9 aa, Homo sapiens
SILAHQCDF

SEQ ID NO: 1091 - protein, 9 aa, Homo sapiens
FDPARFLDK

SEQ ID NO: 1092 - protein, 9 aa, Homo sapiens
ATTANTSVL

SEQ ID NO: 1093 - protein, 9 aa, Homo sapiens
IPHATTANT

SEQ ID NO: 1094 - protein, 9 aa, Homo sapiens
LYEAMRFSS

SEQ ID NO: 1095 - protein, 9 aa, Homo sapiens
YVLAFLYEA

SEQ ID NO: 1096 - protein, 9 aa, Homo sapiens
RVQAELDQV

SEQ ID NO: 1097 - protein, 9 aa, Homo sapiens
LSTALQWLL

SEQ ID NO: 1098 - protein, 9 aa, Homo sapiens
IFGASQDTL

SEQ ID NO: 1099 - protein, 9 aa, Homo sapiens
NVPATITDI

SEQ ID NO: 1100 - protein, 9 aa, Homo sapiens
GGGARLDLE

SEQ ID NO: 1101 - protein, 9 aa, Homo sapiens
KKAAGDSHG

SEQ ID NO: 1102 - protein, 9 aa, Homo sapiens
EKKAAGDSH

SEQ ID NO: 1103 - protein, 9 aa, Homo sapiens
ILSAEKKAA

SEQ ID NO: 1104 - protein, 9 aa, Homo sapiens
MMDAFILSA

SEQ ID NO: 1105 - protein, 9 aa, Homo sapiens
PGAAPRDMM

SEQ ID NO: 1106 - protein, 9 aa, Homo sapiens
RPGAAPRDM

SEQ ID NO: 1107 - protein, 9 aa, Homo sapiens
TVGAGSLVD

SEQ ID NO: 1108 - protein, 9 aa, Homo sapiens
VMSAVCFGC

SEQ ID NO: 1109 - protein, 9 aa, Homo sapiens
VAVANVMSA

SEQ ID NO: 1110 - protein, 9 aa, Homo sapiens
TVVAVANVM

SEQ ID NO: 1111 - protein, 9 aa, Homo sapiens
ADGAFLDPR

SEQ ID NO: 1112 - protein, 9 aa, Homo sapiens
RGSADGAFL

SEQ ID NO: 1113 - protein, 9 aa, Homo sapiens
ELVALLVRG

SEQ ID NO: 1114 - protein, 9 aa, Homo sapiens
LSEARELVA

SEQ ID NO: 1115 - protein, 9 aa, Homo sapiens
RRAAHSMMR

SEQ ID NO: 1116 - protein, 9 aa, Homo sapiens
QRRAAHSMM

SEQ ID NO: 1117 - protein, 9 aa, Homo sapiens
RSMAFGHYS

SEQ ID NO: 1118 - protein, 9 aa, Homo sapiens
PAFASFRVV

SEQ ID NO: 1119 - protein, 9 aa, Homo sapiens
DRPAFASFR

SEQ ID NO: 1120 - protein, 9 aa, Homo sapiens
SAFADRPAF

SEQ ID NO: 1121 - protein, 9 aa, Homo sapiens
QGSAFADRP

SEQ ID NO: 1122 - protein, 9 aa, Homo sapiens
IHQALVQQG

SEQ ID NO: 1123 - protein, 9 aa, Homo sapiens
GERAIHQAL

SEQ ID NO: 1124 - protein, 9 aa, Homo sapiens
ARLARRYGD

SEQ ID NO: 1125 - protein, 9 aa, Homo sapiens
LSFARLARR

SEQ ID NO: 1126 - protein, 9 aa, Homo sapiens
GQAAHLSFA

SEQ ID NO: 1127 - protein, 9 aa, Homo sapiens
VGQAAHLSF

SEQ ID NO: 1128 - protein, 9 aa, Homo sapiens
NAAAVGQAA

SEQ ID NO: 1129 - protein, 9 aa, Homo sapiens
GNAAAVGQA

SEQ ID NO: 1130 - protein, 9 aa, Homo sapiens
IGNAAAVGQ

SEQ ID NO: 1131 - protein, 9 aa, Homo sapiens
GPFAWPLIG

SEQ ID NO: 1132 - protein, 9 aa, Homo sapiens
LRSAPPGPF

SEQ ID NO: 1133 - protein, 9 aa, Homo sapiens
SVLATVHVG

SEQ ID NO: 1134 - protein, 10 aa, Homo sapiens
AAAVGQAAHL

SEQ ID NO: 1135 - protein, 10 aa, Homo sapiens
KAAGDSHGGG

SEQ ID NO: 1136 - protein, 10 aa, Homo sapiens
GAAPRDMMDA

SEQ ID NO: 1137 - protein, 10 aa, Homo sapiens
RAAHSMMRNF

SEQ ID NO: 1138 - protein, 10 aa, Homo sapiens
QAAHLSFARL

SEQ ID NO: 1139 - protein, 10 aa, Homo sapiens
NAAAVGQAAH

SEQ ID NO: 1140 - protein, 10 aa, Homo sapiens
AVANVMSAVC

SEQ ID NO: 1141 - protein, 10 aa, Homo sapiens
AFASFRVVSG

SEQ ID NO: 1142 - protein, 10 aa, Homo sapiens
AFADRPAFAS

SEQ ID NO: 1143 - protein, 10 aa, Homo sapiens
DSAVQNLQAK

SEQ ID NO: 1144 - protein, 10 aa, Homo sapiens
EPAKMNFSYG

SEQ ID NO: 1145 - protein, 10 aa, Homo sapiens
FRANPNEPAK

SEQ ID NO: 1146 - protein, 10 aa, Homo sapiens
ILAHQCDFRA

SEQ ID NO: 1147 - protein, 10 aa, Homo sapiens
DPARFLDKDG

SEQ ID NO: 1148 - protein, 10 aa, Homo sapiens
TTANTSVLGY

SEQ ID NO: 1149 - protein, 10 aa, Homo sapiens
PHATTANTSV

SEQ ID NO: 1150 - protein, 10 aa, Homo sapiens
YEAMRFSSFV

SEQ ID NO: 1151 - protein, 10 aa, Homo sapiens
VLAFLYEAMR

SEQ ID NO: 1152 - protein, 10 aa, Homo sapiens
VQAELDQVVG

SEQ ID NO: 1153 - protein, 10 aa, Homo sapiens
STALQWLLLL

SEQ ID NO: 1154 - protein, 10 aa, Homo sapiens
FGASQDTLST

SEQ ID NO: 1155 - protein, 10 aa, Homo sapiens
VPATITDIFG

SEQ ID NO: 1156 - protein, 10 aa, Homo sapiens
GGARLDLENV

SEQ ID NO: 1157 - protein, 10 aa, Homo sapiens
AAGDSHGGGA

SEQ ID NO: 1158 - protein, 10 aa, Homo sapiens
KKAAGDSHGG

SEQ ID NO: 1159 - protein, 10 aa, Homo sapiens
LSAEKKAAGD

SEQ ID NO: 1160 - protein, 10 aa, Homo sapiens
MDAFILSAEK

SEQ ID NO: 1161 - protein, 10 aa, Homo sapiens
AAPRDMMDAF

SEQ ID NO: 1162 - protein, 10 aa, Homo sapiens
PGAAPRDMMD

SEQ ID NO: 1163 - protein, 10 aa, Homo sapiens
VGAGSLVDVM

SEQ ID NO: 1164 - protein, 10 aa, Homo sapiens
MSAVCFGCRY

SEQ ID NO: 1165 - protein, 10 aa, Homo sapiens
VVAVANVMSA

SEQ ID NO: 1166 - protein, 10 aa, Homo sapiens
DGAFLDPRPL

SEQ ID NO: 1167 - protein, 10 aa, Homo sapiens
GSADGAFLDP

SEQ ID NO: 1168 - protein, 10 aa, Homo sapiens
LVALLVRGSA

SEQ ID NO: 1169 - protein, 10 aa, Homo sapiens
SEARELVALL

SEQ ID NO: 1170 - protein, 10 aa, Homo sapiens
AAHSMMRNFF

SEQ ID NO: 1171 - protein, 10 aa, Homo sapiens
RRAAHSMMRN

SEQ ID NO: 1172 - protein, 10 aa, Homo sapiens
SMAFGHYSEH

SEQ ID NO: 1173 - protein, 10 aa, Homo sapiens
RPAFASFRVV

SEQ ID NO: 1174 - protein, 10 aa, Homo sapiens
GSAFADRPAF

SEQ ID NO: 1175 - protein, 10 aa, Homo sapiens
HQALVQQGSA

SEQ ID NO: 1176 - protein, 10 aa, Homo sapiens
ERAIHQALVQ

SEQ ID NO: 1177 - protein, 10 aa, Homo sapiens
RLARRYGDVF

SEQ ID NO: 1178 - protein, 10 aa, Homo sapiens
SFARLARRYG

SEQ ID NO: 1179 - protein, 10 aa, Homo sapiens
AAHLSFARLA

SEQ ID NO: 1180 - protein, 10 aa, Homo sapiens
GQAAHLSFAR

SEQ ID NO: 1181 - protein, 10 aa, Homo sapiens
AAVGQAAHLS

SEQ ID NO: 1182 - protein, 10 aa, Homo sapiens
GNAAAVGQAA

SEQ ID NO: 1183 - protein, 10 aa, Homo sapiens
PFAWPLIGNA

SEQ ID NO: 1184 - protein, 10 aa, Homo sapiens
RSAPPGPFAW

SEQ ID NO: 1185 - protein, 10 aa, Homo sapiens
VLATVHVGQR

SEQ ID NO: 1186 - protein, 10 aa, Homo sapiens
SAVQNLQAKE

SEQ ID NO: 1187 - protein, 10 aa, Homo sapiens
PAKMNFSYGL

SEQ ID NO: 1188 - protein, 10 aa, Homo sapiens
RANPNEPAKM

SEQ ID NO: 1189 - protein, 10 aa, Homo sapiens
LAHQCDFRAN

SEQ ID NO: 1190 - protein, 10 aa, Homo sapiens
PARFLDKDGL

SEQ ID NO: 1191 - protein, 10 aa, Homo sapiens
TANTSVLGYH

SEQ ID NO: 1192 - protein, 10 aa, Homo sapiens
HATTANTSVL

SEQ ID NO: 1193 - protein, 10 aa, Homo sapiens
EAMRFSSFVP

SEQ ID NO: 1194 - protein, 10 aa, Homo sapiens
LAFLYEAMRF

SEQ ID NO: 1195 - protein, 10 aa, Homo sapiens
QAELDQVVGR

SEQ ID NO: 1196 - protein, 10 aa, Homo sapiens
TALQWLLLLF

SEQ ID NO: 1197 - protein, 10 aa, Homo sapiens
GASQDTLSTA

SEQ ID NO: 1198 - protein, 10 aa, Homo sapiens
PATITDIFGA

SEQ ID NO: 1199 - protein, 10 aa, Homo sapiens
GARLDLENVP

SEQ ID NO: 1200 - protein, 10 aa, Homo sapiens
SAEKKAAGDS

SEQ ID NO: 1201 - protein, 10 aa, Homo sapiens
DAFILSAEKK

SEQ ID NO: 1202 - protein, 10 aa, Homo sapiens
GAGSLVDVMP

SEQ ID NO: 1203 - protein, 10 aa, Homo sapiens
SAVCFGCRYS

SEQ ID NO: 1204 - protein, 10 aa, Homo sapiens
VANVMSAVCF

SEQ ID NO: 1205 - protein, 10 aa, Homo sapiens
VAVANVMSAV

SEQ ID NO: 1206 - protein, 10 aa, Homo sapiens
GAFLDPRPLT

SEQ ID NO: 1207 - protein, 10 aa, Homo sapiens
SADGAFLDPR

SEQ ID NO: 1208 - protein, 10 aa, Homo sapiens
VALLVRGSAD

SEQ ID NO: 1209 - protein, 10 aa, Homo sapiens
EARELVALLV

SEQ ID NO: 1210 - protein, 10 aa, Homo sapiens
MAFGHYSEHW

SEQ ID NO: 1211 - protein, 10 aa, Homo sapiens
FASFRVVSGG

SEQ ID NO: 1212 - protein, 10 aa, Homo sapiens
PAFASFRVVS

SEQ ID NO: 1213 - protein, 10 aa, Homo sapiens
FADRPAFASF

SEQ ID NO: 1214 - protein, 10 aa, Homo sapiens
SAFADRPAFA

SEQ ID NO: 1215 - protein, 10 aa, Homo sapiens
QALVQQGSAF

SEQ ID NO: 1216 - protein, 10 aa, Homo sapiens
RAIHQALVQQ

SEQ ID NO: 1217 - protein, 10 aa, Homo sapiens
LARRYGDVFQ

SEQ ID NO: 1218 - protein, 10 aa, Homo sapiens
FARLARRYGD

SEQ ID NO: 1219 - protein, 10 aa, Homo sapiens
FAWPLIGNAA

SEQ ID NO: 1220 - protein, 10 aa, Homo sapiens
SAPPGPFAWP

SEQ ID NO: 1221 - protein, 10 aa, Homo sapiens
LATVHVGQRL

SEQ ID NO: 1222 - protein, 10 aa, Homo sapiens
AVQNLQAKET

SEQ ID NO: 1223 - protein, 10 aa, Homo sapiens
AKMNFSYGLT

SEQ ID NO: 1224 - protein, 10 aa, Homo sapiens
ANPNEPAKMN

SEQ ID NO: 1225 - protein, 10 aa, Homo sapiens
AHQCDFRANP

SEQ ID NO: 1226 - protein, 10 aa, Homo sapiens
ARFLDKDGLI

SEQ ID NO: 1227 - protein, 10 aa, Homo sapiens
ANTSVLGYHI

SEQ ID NO: 1228 - protein, 10 aa, Homo sapiens
ATTANTSVLG

SEQ ID NO: 1229 - protein, 10 aa, Homo sapiens
AMRFSSFVPV

SEQ ID NO: 1230 - protein, 10 aa, Homo sapiens
AFLYEAMRFS

SEQ ID NO: 1231 - protein, 10 aa, Homo sapiens
AELDQVVGRD

SEQ ID NO: 1232 - protein, 10 aa, Homo sapiens
ALQWLLLLFT

SEQ ID NO: 1233 - protein, 10 aa, Homo sapiens
ASQDTLSTAL

SEQ ID NO: 1234 - protein, 10 aa, Homo sapiens
ATITDIFGAS

SEQ ID NO: 1235 - protein, 10 aa, Homo sapiens
ARLDLENVPA

SEQ ID NO: 1236 - protein, 10 aa, Homo sapiens
AGDSHGGGAR

SEQ ID NO: 1237 - protein, 10 aa, Homo sapiens
AEKKAAGDSH

SEQ ID NO: 1238 - protein, 10 aa, Homo sapiens
AFILSAEKKA

SEQ ID NO: 1239 - protein, 10 aa, Homo sapiens
APRDMMDAFI

SEQ ID NO: 1240 - protein, 10 aa, Homo sapiens
AGSLVDVMPW

SEQ ID NO: 1241 - protein, 10 aa, Homo sapiens
AVCFGCRYSH

SEQ ID NO: 1242 - protein, 10 aa, Homo sapiens
ANVMSAVCFG

SEQ ID NO: 1243 - protein, 10 aa, Homo sapiens
AFLDPRPLTV

SEQ ID NO: 1244 - protein, 10 aa, Homo sapiens
ADGAFLDPRP

SEQ ID NO: 1245 - protein, 10 aa, Homo sapiens
ALLVRGSADG

SEQ ID NO: 1246 - protein, 10 aa, Homo sapiens
ARELVALLVR

SEQ ID NO: 1247 - protein, 10 aa, Homo sapiens
AHSMMRNFFT

SEQ ID NO: 1248 - protein, 10 aa, Homo sapiens
AFGHYSEHWK

SEQ ID NO: 1249 - protein, 10 aa, Homo sapiens
ASFRVVSGGR

SEQ ID NO: 1250 - protein, 10 aa, Homo sapiens
ADRPAFASFR

SEQ ID NO: 1251 - protein, 10 aa, Homo sapiens
ALVQQGSAFA

SEQ ID NO: 1252 - protein, 10 aa, Homo sapiens
AIHQALVQQG

SEQ ID NO: 1253 - protein, 10 aa, Homo sapiens
ARRYGDVFQI

SEQ ID NO: 1254 - protein, 10 aa, Homo sapiens
ARLARRYGDV

SEQ ID NO: 1255 - protein, 10 aa, Homo sapiens
AHLSFARLAR

SEQ ID NO: 1256 - protein, 10 aa, Homo sapiens
AVGQAAHLSF

SEQ ID NO: 1257 - protein, 10 aa, Homo sapiens
AWPLIGNAAA

SEQ ID NO: 1258 - protein, 10 aa, Homo sapiens
APPGPFAWPL

SEQ ID NO: 1259 - protein, 10 aa, Homo sapiens
ATVHVGQRLL

SEQ ID NO: 1260 - protein, 9 aa, Homo sapiens
NAAAVGQAA

SEQ ID NO: 1261 - protein, 9 aa, Homo sapiens
AFADRPAFA

SEQ ID NO: 1262 - protein, 9 aa, Homo sapiens
DSAVQNLQA

SEQ ID NO: 1263 - protein, 9 aa, Homo sapiens
FRANPNEPA

SEQ ID NO: 1264 - protein, 9 aa, Homo sapiens
AAPRDMMDA

SEQ ID NO: 1265 - protein, 9 aa, Homo sapiens
GSAFADRPA

SEQ ID NO: 1266 - protein, 9 aa, Homo sapiens
GQAAHLSFA

SEQ ID NO: 1267 - protein, 9 aa, Homo sapiens
GNAAAVGQA

SEQ ID NO: 1268 - protein, 9 aa, Homo sapiens
RSAPPGPFA

SEQ ID NO: 1269 - protein, 9 aa, Homo sapiens
LAHQCDFRA

SEQ ID NO: 1270 - protein, 9 aa, Homo sapiens
VAVANVMSA

SEQ ID NO: 1271 - protein, 9 aa, Homo sapiens
VALLVRGSA

SEQ ID NO: 1272 - protein, 9 aa, Homo sapiens
QALVQQGSA

SEQ ID NO: 1273 - protein, 9 aa, Homo sapiens
FAWPLIGNA

SEQ ID NO: 1274 - protein, 9 aa, Homo sapiens
ASQDTLSTA

SEQ ID NO: 1275 - protein, 9 aa, Homo sapiens
ATITDIFGA

SEQ ID NO: 1276 - protein, 9 aa, Homo sapiens
AGDSHGGGA

SEQ ID NO: 1277 - protein, 9 aa, Homo sapiens
AHLSFARLA

SEQ ID NO: 1278 - protein, 9 aa, Homo sapiens
AWPLIGNAA

SEQ ID NO: 1279 - protein, 9 aa, Homo sapiens
ESMELLDSA

SEQ ID NO: 1280 - protein, 9 aa, Homo sapiens
LFLFISILA

SEQ ID NO: 1281 - protein, 9 aa, Homo sapiens
PNPENFDPA

SEQ ID NO: 1282 - protein, 9 aa, Homo sapiens
VTIPHATTA

SEQ ID NO: 1283 - protein, 9 aa, Homo sapiens
FVPVTIPHA

SEQ ID NO: 1284 - protein, 9 aa, Homo sapiens
YVLAFLYEA

SEQ ID NO: 1285 - protein, 9 aa, Homo sapiens
QPNLPYVLA

SEQ ID NO: 1286 - protein, 9 aa, Homo sapiens
PDVQTRVQA

SEQ ID NO: 1287 - protein, 9 aa, Homo sapiens
RLDLENVPA

SEQ ID NO: 1288 - protein, 9 aa, Homo sapiens
ILSAEKKAA

SEQ ID NO: 1289 - protein, 9 aa, Homo sapiens
FILSAEKKA

SEQ ID NO: 1290 - protein, 9 aa, Homo sapiens
MMDAFILSA

SEQ ID NO: 1291 - protein, 9 aa, Homo sapiens
CESLRPGAA

SEQ ID NO: 1292 - protein, 9 aa, Homo sapiens
HCESLRPGA

SEQ ID NO: 1293 - protein, 9 aa, Homo sapiens
EEFGRTVGA

SEQ ID NO: 1294 - protein, 9 aa, Homo sapiens
RPLTVVAVA

SEQ ID NO: 1295 - protein, 9 aa, Homo sapiens
DPRPLTVVA

SEQ ID NO: 1296 - protein, 9 aa, Homo sapiens
LVRGSADGA

SEQ ID NO: 1297 - protein, 9 aa, Homo sapiens
LSEARELVA

SEQ ID NO: 1298 - protein, 9 aa, Homo sapiens
LEGHVLSEA

SEQ ID NO: 1299 - protein, 9 aa, Homo sapiens
HWKVQRRAA

SEQ ID NO: 1300 - protein, 9 aa, Homo sapiens
EHWKVQRRA

SEQ ID NO: 1301 - protein, 9 aa, Homo sapiens
VVSGGRSMA

SEQ ID NO: 1302 - protein, 9 aa, Homo sapiens
LVQQGSAFA

SEQ ID NO: 1303 - protein, 9 aa, Homo sapiens
NGERAIHQA

SEQ ID NO: 1304 - protein, 9 aa, Homo sapiens
IVVLNGERA

SEQ ID NO: 1305 - protein, 9 aa, Homo sapiens
WPLIGNAAA

SEQ ID NO: 1306 - protein, 9 aa, Homo sapiens
QRRRQLRSA

SEQ ID NO: 1307 - protein, 9 aa, Homo sapiens
LLLLLSVLA

SEQ ID NO: 1308 - protein, 9 aa, Homo sapiens
AAAVGQAAH

SEQ ID NO: 1309 - protein, 9 aa, Homo sapiens
KAAGDSHGG

SEQ ID NO: 1310 - protein, 9 aa, Homo sapiens
GAAPRDMMD

SEQ ID NO: 1311 - protein, 9 aa, Homo sapiens
RAAHSMMRN

SEQ ID NO: 1312 - protein, 9 aa, Homo sapiens
QAAHLSFAR

SEQ ID NO: 1313 - protein, 9 aa, Homo sapiens
AVANVMSAV

SEQ ID NO: 1314 - protein, 9 aa, Homo sapiens
AFASFRVVS

SEQ ID NO: 1315 - protein, 9 aa, Homo sapiens
EPAKMNFSY

SEQ ID NO: 1316 - protein, 9 aa, Homo sapiens
ILAHQCDFR

SEQ ID NO: 1317 - protein, 9 aa, Homo sapiens
DPARFLDKD

SEQ ID NO: 1318 - protein, 9 aa, Homo sapiens
TTANTSVLG

SEQ ID NO: 1319 - protein, 9 aa, Homo sapiens
PHATTANTS

SEQ ID NO: 1320 - protein, 9 aa, Homo sapiens
YEAMRFSSF

SEQ ID NO: 1321 - protein, 9 aa, Homo sapiens
VLAFLYEAM

SEQ ID NO: 1322 - protein, 9 aa, Homo sapiens
VQAELDQVV

SEQ ID NO: 1323 - protein, 9 aa, Homo sapiens
STALQWLLL

SEQ ID NO: 1324 - protein, 9 aa, Homo sapiens
FGASQDTLS

SEQ ID NO: 1325 - protein, 9 aa, Homo sapiens
VPATITDIF

SEQ ID NO: 1326 - protein, 9 aa, Homo sapiens
GGARLDLEN

SEQ ID NO: 1327 - protein, 9 aa, Homo sapiens
AAGDSHGGG

SEQ ID NO: 1328 - protein, 9 aa, Homo sapiens
KKAAGDSHG

SEQ ID NO: 1329 - protein, 9 aa, Homo sapiens
LSAEKKAAG

SEQ ID NO: 1330 - protein, 9 aa, Homo sapiens
MDAFILSAE

SEQ ID NO: 1331 - protein, 9 aa, Homo sapiens
PGAAPRDMM

SEQ ID NO: 1332 - protein, 9 aa, Homo sapiens
VGAGSLVDV

SEQ ID NO: 1333 - protein, 9 aa, Homo sapiens
MSAVCFGCR

SEQ ID NO: 1334 - protein, 9 aa, Homo sapiens
VVAVANVMS

SEQ ID NO: 1335 - protein, 9 aa, Homo sapiens
DGAFLDPRP

SEQ ID NO: 1336 - protein, 9 aa, Homo sapiens
GSADGAFLD

SEQ ID NO: 1337 - protein, 9 aa, Homo sapiens
LVALLVRGS

SEQ ID NO: 1338 - protein, 9 aa, Homo sapiens
SEARELVAL

SEQ ID NO: 1339 - protein, 9 aa, Homo sapiens
AAHSMMRNF

SEQ ID NO: 1340 - protein, 9 aa, Homo sapiens
RRAAHSMMR

SEQ ID NO: 1341 - protein, 9 aa, Homo sapiens
SMAFGHYSE

SEQ ID NO: 1342 - protein, 9 aa, Homo sapiens
RPAFASFRV

SEQ ID NO: 1343 - protein, 9 aa, Homo sapiens
HQALVQQGS

SEQ ID NO: 1344 - protein, 9 aa, Homo sapiens
ERAIHQALV

SEQ ID NO: 1345 - protein, 9 aa, Homo sapiens
RLARRYGDV

SEQ ID NO: 1346 - protein, 9 aa, Homo sapiens
SFARLARRY

SEQ ID NO: 1347 - protein, 9 aa, Homo sapiens
AAHLSFARL

SEQ ID NO: 1348 - protein, 9 aa, Homo sapiens
AAVGQAAHL

SEQ ID NO: 1349 - protein, 9 aa, Homo sapiens
PFAWPLIGN

SEQ ID NO: 1350 - protein, 9 aa, Homo sapiens
VLATVHVGQ

SEQ ID NO: 1351 - protein, 9 aa, Homo sapiens
SAVQNLQAK

SEQ ID NO: 1352 - protein, 9 aa, Homo sapiens
PAKMNFSYG

SEQ ID NO: 1353 - protein, 9 aa, Homo sapiens
RANPNEPAK

SEQ ID NO: 1354 - protein, 9 aa, Homo sapiens
PARFLDKDG

SEQ ID NO: 1355 - protein, 9 aa, Homo sapiens
TANTSVLGY

SEQ ID NO: 1356 - protein, 9 aa, Homo sapiens
HATTANTSV

SEQ ID NO: 1357 - protein, 9 aa, Homo sapiens
EAMRFSSFV

SEQ ID NO: 1358 - protein, 9 aa, Homo sapiens
LAFLYEAMR

SEQ ID NO: 1359 - protein, 9 aa, Homo sapiens
QAELDQVVG

SEQ ID NO: 1360 - protein, 9 aa, Homo sapiens
TALQWLLLL

SEQ ID NO: 1361 - protein, 9 aa, Homo sapiens
GASQDTLST

SEQ ID NO: 1362 - protein, 9 aa, Homo sapiens
PATITDIFG

SEQ ID NO: 1363 - protein, 9 aa, Homo sapiens
GARLDLENV

SEQ ID NO: 1364 - protein, 9 aa, Homo sapiens
SAEKKAAGD

SEQ ID NO: 1365 - protein, 9 aa, Homo sapiens
DAFILSAEK

SEQ ID NO: 1366 - protein, 9 aa, Homo sapiens
GAGSLVDVM

SEQ ID NO: 1367 - protein, 9 aa, Homo sapiens
SAVCFGCRY

SEQ ID NO: 1368 - protein, 9 aa, Homo sapiens
VANVMSAVC

SEQ ID NO: 1369 - protein, 9 aa, Homo sapiens
GAFLDPRPL

SEQ ID NO: 1370 - protein, 9 aa, Homo sapiens
SADGAFLDP

SEQ ID NO: 1371 - protein, 9 aa, Homo sapiens
EARELVALL

SEQ ID NO: 1372 - protein, 9 aa, Homo sapiens
MAFGHYSEH

SEQ ID NO: 1373 - protein, 9 aa, Homo sapiens
FASFRVVSG

SEQ ID NO: 1374 - protein, 9 aa, Homo sapiens
PAFASFRVV

SEQ ID NO: 1375 - protein, 9 aa, Homo sapiens
FADRPAFAS

SEQ ID NO: 1376 - protein, 9 aa, Homo sapiens
SAFADRPAF

SEQ ID NO: 1377 - protein, 9 aa, Homo sapiens
RAIHQALVQ

SEQ ID NO: 1378 - protein, 9 aa, Homo sapiens
LARRYGDVF

SEQ ID NO: 1379 - protein, 9 aa, Homo sapiens
FARLARRYG

SEQ ID NO: 1380 - protein, 9 aa, Homo sapiens
SAPPGPFAW

SEQ ID NO: 1381 - protein, 9 aa, Homo sapiens
LATVHVGQR

SEQ ID NO: 1382 - protein, 9 aa, Homo sapiens
AVQNLQAKE

SEQ ID NO: 1383 - protein, 9 aa, Homo sapiens
AKMNFSYGL

SEQ ID NO: 1384 - protein, 9 aa, Homo sapiens
ANPNEPAKM

SEQ ID NO: 1385 - protein, 9 aa, Homo sapiens
AHQCDFRAN

SEQ ID NO: 1386 - protein, 9 aa, Homo sapiens
ARFLDKDGL

SEQ ID NO: 1387 - protein, 9 aa, Homo sapiens
ANTSVLGYH

SEQ ID NO: 1388 - protein, 9 aa, Homo sapiens
ATTANTSVL

SEQ ID NO: 1389 - protein, 9 aa, Homo sapiens
AMRFSSFVP

SEQ ID NO: 1390 - protein, 9 aa, Homo sapiens
AFLYEAMRF

SEQ ID NO: 1391 - protein, 9 aa, Homo sapiens
AELDQVVGR

SEQ ID NO: 1392 - protein, 9 aa, Homo sapiens
ALQWLLLLF

SEQ ID NO: 1393 - protein, 9 aa, Homo sapiens
ARLDLENVP

SEQ ID NO: 1394 - protein, 9 aa, Homo sapiens
AEKKAAGDS

SEQ ID NO: 1395 - protein, 9 aa, Homo sapiens
AFILSAEKK

SEQ ID NO: 1396 - protein, 9 aa, Homo sapiens
APRDMMDAF

SEQ ID NO: 1397 - protein, 9 aa, Homo sapiens
AGSLVDVMP

SEQ ID NO: 1398 - protein, 9 aa, Homo sapiens
AVCFGCRYS

SEQ ID NO: 1399 - protein, 9 aa, Homo sapiens
ANVMSAVCF

SEQ ID NO: 1400 - protein, 9 aa, Homo sapiens
AFLDPRPLT

SEQ ID NO: 1401 - protein, 9 aa, Homo sapiens
ADGAFLDPR

SEQ ID NO: 1402 - protein, 9 aa, Homo sapiens
ALLVRGSAD

SEQ ID NO: 1403 - protein, 9 aa, Homo sapiens
ARELVALLV

SEQ ID NO: 1404 - protein, 9 aa, Homo sapiens
AHSMMRNFF

SEQ ID NO: 1405 - protein, 9 aa, Homo sapiens
AFGHYSEHW

SEQ ID NO: 1406 - protein, 9 aa, Homo sapiens
ASFRVVSGG

SEQ ID NO: 1407 - protein, 9 aa, Homo sapiens
ADRPAFASF

SEQ ID NO: 1408 - protein, 9 aa, Homo sapiens
ALVQQGSAF

SEQ ID NO: 1409 - protein, 9 aa, Homo sapiens
AIHQALVQQ

SEQ ID NO: 1410 - protein, 9 aa, Homo sapiens
ARRYGDVFQ

SEQ ID NO: 1411 - protein, 9 aa, Homo sapiens
ARLARRYGD

SEQ ID NO: 1412 - protein, 9 aa, Homo sapiens
AVGQAAHLS

SEQ ID NO: 1413 - protein, 9 aa, Homo sapiens
APPGPFAWP

SEQ ID NO: 1414 - protein, 9 aa, Homo sapiens
ATVHVGQRL

SEQ ID NO: 1415 - protein, 10 aa, Homo sapiens
AWPLIGNAAA

SEQ ID NO: 1416 - protein, 10 aa, Homo sapiens
FILSAEKKAA

SEQ ID NO: 1417 - protein, 10 aa, Homo sapiens
HCESLRPGAA

SEQ ID NO: 1418 - protein, 10 aa, Homo sapiens
EHWKVQRRAA

SEQ ID NO: 1419 - protein, 10 aa, Homo sapiens
GNAAAVGQAA

SEQ ID NO: 1420 - protein, 10 aa, Homo sapiens
FAWPLIGNAA

SEQ ID NO: 1421 - protein, 10 aa, Homo sapiens
PRPLTVVAVA

SEQ ID NO: 1422 - protein, 10 aa, Homo sapiens
SAFADRPAFA

SEQ ID NO: 1423 - protein, 10 aa, Homo sapiens
ALVQQGSAFA

SEQ ID NO: 1424 - protein, 10 aa, Homo sapiens
ILSAEKKAAG

SEQ ID NO: 1425 - protein, 10 aa, Homo sapiens
CESLRPGAAP

SEQ ID NO: 1426 - protein, 10 aa, Homo sapiens
HWKVQRRAAH

SEQ ID NO: 1427 - protein, 10 aa, Homo sapiens
NAAAVGQAAH

SEQ ID NO: 1428 - protein, 10 aa, Homo sapiens
WPLIGNAAAV

SEQ ID NO: 1429 - protein, 10 aa, Homo sapiens
LDSAVQNLQA

SEQ ID NO: 1430 - protein, 10 aa, Homo sapiens
RESMELLDSA

SEQ ID NO: 1431 - protein, 10 aa, Homo sapiens
DFRANPNEPA

SEQ ID NO: 1432 - protein, 10 aa, Homo sapiens
ILAHQCDFRA

SEQ ID NO: 1433 - protein, 10 aa, Homo sapiens
QLFLFISILA

SEQ ID NO: 1434 - protein, 10 aa, Homo sapiens
WPNPENFDPA

SEQ ID NO: 1435 - protein, 10 aa, Homo sapiens
PVTIPHATTA

SEQ ID NO: 1436 - protein, 10 aa, Homo sapiens
SFVPVTIPHA

SEQ ID NO: 1437 - protein, 10 aa, Homo sapiens
PYVLAFLYEA

SEQ ID NO: 1438 - protein, 10 aa, Homo sapiens
DQPNLPYVLA

SEQ ID NO: 1439 - protein, 10 aa, Homo sapiens
YPDVQTRVQA

SEQ ID NO: 1440 - protein, 10 aa, Homo sapiens
GASQDTLSTA

SEQ ID NO: 1441 - protein, 10 aa, Homo sapiens
PATITDIFGA

SEQ ID NO: 1442 - protein, 10 aa, Homo sapiens
ARLDLENVPA

SEQ ID NO: 1443 - protein, 10 aa, Homo sapiens
AAGDSHGGGA

SEQ ID NO: 1444 - protein, 10 aa, Homo sapiens
AFILSAEKKA

SEQ ID NO: 1445 - protein, 10 aa, Homo sapiens
DMMDAFILSA

SEQ ID NO: 1446 - protein, 10 aa, Homo sapiens
GAAPRDMMDA

SEQ ID NO: 1447 - protein, 10 aa, Homo sapiens
RHCESLRPGA

SEQ ID NO: 1448 - protein, 10 aa, Homo sapiens
NEEFGRTVGA

SEQ ID NO: 1449 - protein, 10 aa, Homo sapiens
VVAVANVMSA

SEQ ID NO: 1450 - protein, 10 aa, Homo sapiens
LDPRPLTVVA

SEQ ID NO: 1451 - protein, 10 aa, Homo sapiens
LLVRGSADGA

SEQ ID NO: 1452 - protein, 10 aa, Homo sapiens
LVALLVRGSA

SEQ ID NO: 1453 - protein, 10 aa, Homo sapiens
VLSEARELVA

SEQ ID NO: 1454 - protein, 10 aa, Homo sapiens
VLEGHVLSEA

SEQ ID NO: 1455 - protein, 10 aa, Homo sapiens
SEHWKVQRRA

SEQ ID NO: 1456 - protein, 10 aa, Homo sapiens
RVVSGGRSMA

SEQ ID NO: 1457 - protein, 10 aa, Homo sapiens
QGSAFADRPA

SEQ ID NO: 1458 - protein, 10 aa, Homo sapiens
HQALVQQGSA

SEQ ID NO: 1459 - protein, 10 aa, Homo sapiens
LNGERAIHQA

SEQ ID NO: 1460 - protein, 10 aa, Homo sapiens
PIVVLNGERA

SEQ ID NO: 1461 - protein, 10 aa, Homo sapiens
AAHLSFARLA

SEQ ID NO: 1462 - protein, 10 aa, Homo sapiens
VGQAAHLSFA

SEQ ID NO: 1463 - protein, 10 aa, Homo sapiens
IGNAAAVGQA

SEQ ID NO: 1464 - protein, 10 aa, Homo sapiens
PFAWPLIGNA

SEQ ID NO: 1465 - protein, 10 aa, Homo sapiens
LRSAPPGPFA

SEQ ID NO: 1466 - protein, 10 aa, Homo sapiens
RQRRRQLRSA

SEQ ID NO: 1467 - protein, 10 aa, Homo sapiens
TLLLLLSVLA

SEQ ID NO: 1468 - protein, 10 aa, Homo sapiens
DSAVQNLQAK

SEQ ID NO: 1469 - protein, 10 aa, Homo sapiens
ESMELLDSAV

SEQ ID NO: 1470 - protein, 10 aa, Homo sapiens
FRANPNEPAK

SEQ ID NO: 1471 - protein, 10 aa, Homo sapiens
LAHQCDFRAN

SEQ ID NO: 1472 - protein, 10 aa, Homo sapiens
LFLFISILAH

SEQ ID NO: 1473 - protein, 10 aa, Homo sapiens
PNPENFDPAR

SEQ ID NO: 1474 - protein, 10 aa, Homo sapiens
VTIPHATTAN

SEQ ID NO: 1475 - protein, 10 aa, Homo sapiens
FVPVTIPHAT

SEQ ID NO: 1476 - protein, 10 aa, Homo sapiens
YVLAFLYEAM

SEQ ID NO: 1477 - protein, 10 aa, Homo sapiens
QPNLPYVLAF

SEQ ID NO: 1478 - protein, 10 aa, Homo sapiens
PDVQTRVQAE

SEQ ID NO: 1479 - protein, 10 aa, Homo sapiens
ASQDTLSTAL

SEQ ID NO: 1480 - protein, 10 aa, Homo sapiens
ATITDIFGAS

SEQ ID NO: 1481 - protein, 10 aa, Homo sapiens
RLDLENVPAT

SEQ ID NO: 1482 - protein, 10 aa, Homo sapiens
AGDSHGGGAR

SEQ ID NO: 1483 - protein, 10 aa, Homo sapiens
MMDAFILSAE

SEQ ID NO: 1484 - protein, 10 aa, Homo sapiens
AAPRDMMDAF

SEQ ID NO: 1485 - protein, 10 aa, Homo sapiens
EEFGRTVGAG

SEQ ID NO: 1486 - protein, 10 aa, Homo sapiens
VAVANVMSAV

SEQ ID NO: 1487 - protein, 10 aa, Homo sapiens
RPLTVVAVAN

SEQ ID NO: 1488 - protein, 10 aa, Homo sapiens
DPRPLTVVAV

SEQ ID NO: 1489 - protein, 10 aa, Homo sapiens
LVRGSADGAF

SEQ ID NO: 1490 - protein, 10 aa, Homo sapiens
VALLVRGSAD

SEQ ID NO: 1491 - protein, 10 aa, Homo sapiens
LSEARELVAL

SEQ ID NO: 1492 - protein, 10 aa, Homo sapiens
LEGHVLSEAR

SEQ ID NO: 1493 - protein, 10 aa, Homo sapiens
VVSGGRSMAF

SEQ ID NO: 1494 - protein, 10 aa, Homo sapiens
AFADRPAFAS

SEQ ID NO: 1495 - protein, 10 aa, Homo sapiens
GSAFADRPAF

SEQ ID NO: 1496 - protein, 10 aa, Homo sapiens
LVQQGSAFAD

SEQ ID NO: 1497 - protein, 10 aa, Homo sapiens
QALVQQGSAF

SEQ ID NO: 1498 - protein, 10 aa, Homo sapiens
NGERAIHQAL

SEQ ID NO: 1499 - protein, 10 aa, Homo sapiens
IVVLNGERAI

SEQ ID NO: 1500 - protein, 10 aa, Homo sapiens
AHLSFARLAR

SEQ ID NO: 1501 - protein, 10 aa, Homo sapiens
GQAAHLSFAR

SEQ ID NO: 1502 - protein, 10 aa, Homo sapiens
RSAPPGPFAW

SEQ ID NO: 1503 - protein, 10 aa, Homo sapiens
QRRRQLRSAP

SEQ ID NO: 1504 - protein, 10 aa, Homo sapiens
LLLLLSVLAT

SEQ ID NO: 1505 - protein, 10 aa, Homo sapiens
SAVQNLQAKE

SEQ ID NO: 1506 - protein, 10 aa, Homo sapiens
SMELLDSAVQ

SEQ ID NO: 1507 - protein, 10 aa, Homo sapiens
RANPNEPAKM

SEQ ID NO: 1508 - protein, 10 aa, Homo sapiens
AHQCDFRANP

SEQ ID NO: 1509 - protein, 10 aa, Homo sapiens
FLFISILAHQ

SEQ ID NO: 1510 - protein, 10 aa, Homo sapiens
NPENFDPARF

SEQ ID NO: 1511 - protein, 10 aa, Homo sapiens
TIPHATTANT

SEQ ID NO: 1512 - protein, 10 aa, Homo sapiens
VPVTIPHATT

SEQ ID NO: 1513 - protein, 10 aa, Homo sapiens
VLAFLYEAMR

SEQ ID NO: 1514 - protein, 10 aa, Homo sapiens
PNLPYVLAFL

SEQ ID NO: 1515 - protein, 10 aa, Homo sapiens
DVQTRVQAEL

SEQ ID NO: 1516 - protein, 10 aa, Homo sapiens
SQDTLSTALQ

SEQ ID NO: 1517 - protein, 10 aa, Homo sapiens
TITDIFGASQ

SEQ ID NO: 1518 - protein, 10 aa, Homo sapiens
LDLENVPATI

SEQ ID NO: 1519 - protein, 10 aa, Homo sapiens
GDSHGGGARL

SEQ ID NO: 1520 - protein, 10 aa, Homo sapiens
LSAEKKAAGD

SEQ ID NO: 1521 - protein, 10 aa, Homo sapiens
MDAFILSAEK

SEQ ID NO: 1522 - protein, 10 aa, Homo sapiens
APRDMMDAFI

SEQ ID NO: 1523 - protein, 10 aa, Homo sapiens
ESLRPGAAPR

SEQ ID NO: 1524 - protein, 10 aa, Homo sapiens
EFGRTVGAGS

SEQ ID NO: 1525 - protein, 10 aa, Homo sapiens
AVANVMSAVC

SEQ ID NO: 1526 - protein, 10 aa, Homo sapiens
PLTVVAVANV

SEQ ID NO: 1527 - protein, 10 aa, Homo sapiens
VRGSADGAFL

SEQ ID NO: 1528 - protein, 10 aa, Homo sapiens
ALLVRGSADG

SEQ ID NO: 1529 - protein, 10 aa, Homo sapiens
SEARELVALL

SEQ ID NO: 1530 - protein, 10 aa, Homo sapiens
EGHVLSEARE

SEQ ID NO: 1531 - protein, 10 aa, Homo sapiens
WKVQRRAAHS

SEQ ID NO: 1532 - protein, 10 aa, Homo sapiens
VSGGRSMAFG

SEQ ID NO: 1533 - protein, 10 aa, Homo sapiens
FADRPAFASF

SEQ ID NO: 1534 - protein, 10 aa, Homo sapiens
VQQGSAFADR

SEQ ID NO: 1535 - protein, 10 aa, Homo sapiens
GERAIHQALV

SEQ ID NO: 1536 - protein, 10 aa, Homo sapiens
VVLNGERAIH

SEQ ID NO: 1537 - protein, 10 aa, Homo sapiens
HLSFARLARR

SEQ ID NO: 1538 - protein, 10 aa, Homo sapiens
QAAHLSFARL

SEQ ID NO: 1539 - protein, 10 aa, Homo sapiens
AAAVGQAAHL

SEQ ID NO: 1540 - protein, 10 aa, Homo sapiens
PLIGNAAAVG

SEQ ID NO: 1541 - protein, 10 aa, Homo sapiens
SAPPGPFAWP

SEQ ID NO: 1542 - protein, 10 aa, Homo sapiens
RRRQLRSAPP

SEQ ID NO: 1543 - protein, 10 aa, Homo sapiens
LLLLSVLATV

SEQ ID NO: 1544 - protein, 8 aa, Homo sapiens
SAVQNLQA

SEQ ID NO: 1545 - protein, 8 aa, Homo sapiens
SMELLDSA

SEQ ID NO: 1546 - protein, 8 aa, Homo sapiens
RANPNEPA

SEQ ID NO: 1547 - protein, 8 aa, Homo sapiens
AHQCDFRA

SEQ ID NO: 1548 - protein, 8 aa, Homo sapiens
FLFISILA

SEQ ID NO: 1549 - protein, 8 aa, Homo sapiens
NPENFDPA

SEQ ID NO: 1550 - protein, 8 aa, Homo sapiens
TIPHATTA

SEQ ID NO: 1551 - protein, 8 aa, Homo sapiens
VPVTIPHA

SEQ ID NO: 1552 - protein, 8 aa, Homo sapiens
VLAFLYEA

SEQ ID NO: 1553 - protein, 8 aa, Homo sapiens
PNLPYVLA

SEQ ID NO: 1554 - protein, 8 aa, Homo sapiens
DVQTRVQA

SEQ ID NO: 1555 - protein, 8 aa, Homo sapiens
SQDTLSTA

SEQ ID NO: 1556 - protein, 8 aa, Homo sapiens
TITDIFGA

SEQ ID NO: 1557 - protein, 8 aa, Homo sapiens
LDLENVPA

SEQ ID NO: 1558 - protein, 8 aa, Homo sapiens
GDSHGGGA

SEQ ID NO: 1559 - protein, 8 aa, Homo sapiens
LSAEKKAA

SEQ ID NO: 1560 - protein, 8 aa, Homo sapiens
ILSAEKKA

SEQ ID NO: 1561 - protein, 8 aa, Homo sapiens
MDAFILSA

SEQ ID NO: 1562 - protein, 8 aa, Homo sapiens
APRDMMDA

SEQ ID NO: 1563 - protein, 8 aa, Homo sapiens
ESLRPGAA

SEQ ID NO: 1564 - protein, 8 aa, Homo sapiens
CESLRPGA

SEQ ID NO: 1565 - protein, 8 aa, Homo sapiens
EFGRTVGA

SEQ ID NO: 1566 - protein, 8 aa, Homo sapiens
AVANVMSA

SEQ ID NO: 1567 - protein, 8 aa, Homo sapiens
PLTVVAVA

SEQ ID NO: 1568 - protein, 8 aa, Homo sapiens
PRPLTVVA

SEQ ID NO: 1569 - protein, 8 aa, Homo sapiens
VRGSADGA

SEQ ID NO: 1570 - protein, 8 aa, Homo sapiens
ALLVRGSA

SEQ ID NO: 1571 - protein, 8 aa, Homo sapiens
SEARELVA

SEQ ID NO: 1572 - protein, 8 aa, Homo sapiens
EGHVLSEA

SEQ ID NO: 1573 - protein, 8 aa, Homo sapiens
WKVQRRAA

SEQ ID NO: 1574 - protein, 8 aa, Homo sapiens
HWKVQRRA

SEQ ID NO: 1575 - protein, 8 aa, Homo sapiens
VSGGRSMA

SEQ ID NO: 1576 - protein, 8 aa, Homo sapiens
FADRPAFA

SEQ ID NO: 1577 - protein, 8 aa, Homo sapiens
SAFADRPA

SEQ ID NO: 1578 - protein, 8 aa, Homo sapiens
VQQGSAFA

SEQ ID NO: 1579 - protein, 8 aa, Homo sapiens
ALVQQGSA

SEQ ID NO: 1580 - protein, 8 aa, Homo sapiens
GERAIHQA

SEQ ID NO: 1581 - protein, 8 aa, Homo sapiens
VVLNGERA

SEQ ID NO: 1582 - protein, 8 aa, Homo sapiens
HLSFARLA

SEQ ID NO: 1583 - protein, 8 aa, Homo sapiens
QAAHLSFA

SEQ ID NO: 1584 - protein, 8 aa, Homo sapiens
AAAVGQAA

SEQ ID NO: 1585 - protein, 8 aa, Homo sapiens
NAAAVGQA

SEQ ID NO: 1586 - protein, 8 aa, Homo sapiens
PLIGNAAA

SEQ ID NO: 1587 - protein, 8 aa, Homo sapiens
WPLIGNAA

SEQ ID NO: 1588 - protein, 8 aa, Homo sapiens
AWPLIGNA

SEQ ID NO: 1589 - protein, 8 aa, Homo sapiens
SAPPGPFA

SEQ ID NO: 1590 - protein, 8 aa, Homo sapiens
RRRQLRSA

SEQ ID NO: 1591 - protein, 8 aa, Homo sapiens
LLLLSVLA

SEQ ID NO: 1592 - protein, 9 aa, Homo sapiens
MGDQPNLPY

SEQ ID NO: 1593 - protein, 9 aa, Homo sapiens
VDVMPWLQY

SEQ ID NO: 1594 - protein, 9 aa, Homo sapiens
TANTSVLGY

SEQ ID NO: 1595 - protein, 9 aa, Homo sapiens
FLDPRPLTV

SEQ ID NO: 1596 - protein, 9 aa, Homo sapiens
SADGAFLDP

SEQ ID NO: 1597 - protein, 9 aa, Homo sapiens
ARELVALLV

SEQ ID NO: 1598 - protein, 9 aa, Homo sapiens
LSEARELVA

SEQ ID NO: 1599 - protein, 9 aa, Homo sapiens
VLEGHVLSE

SEQ ID NO: 1600 - protein, 9 aa, Homo sapiens
PNDPWPLNP

SEQ ID NO: 1601 - protein, 9 aa, Homo sapiens
FLDKDGLIN

SEQ ID NO: 1602 - protein, 9 aa, Homo sapiens
WLLLLFTRY

SEQ ID NO: 1603 - protein, 9 aa, Homo sapiens
LRESMELLD

SEQ ID NO: 1604 - protein, 9 aa, Homo sapiens
STALQWLLL

SEQ ID NO: 1605 - protein, 9 aa, Homo sapiens
DPEFRELLS

SEQ ID NO: 1606 - protein, 9 aa, Homo sapiens
SAVCFGCRY

SEQ ID NO: 1607 - protein, 9 aa, Homo sapiens
GRSMAFGHY

SEQ ID NO: 1608 - protein, 9 aa, Homo sapiens
NFDPARFLD

SEQ ID NO: 1609 - protein, 9 aa, Homo sapiens
LPYVLAFLY

SEQ ID NO: 1610 - protein, 9 aa, Homo sapiens
ITDIFGASQ

SEQ ID NO: 1611 - protein, 9 aa, Homo sapiens
FREFEQLNR

SEQ ID NO: 1612 - protein, 9 aa, Homo sapiens
HDDPEFREL

SEQ ID NO: 1613 - protein, 9 aa, Homo sapiens
SFARLARRY

SEQ ID NO: 1614 - protein, 9 aa, Homo sapiens
EPAKMNFSY

SEQ ID NO: 1615 - protein, 9 aa, Homo sapiens
MMDAFILSA

SEQ ID NO: 1616 - protein, 9 aa, Homo sapiens
YSEHWKVQR

SEQ ID NO: 1617 - protein, 9 aa, Homo sapiens
YGDVFQIRL

SEQ ID NO: 1618 - protein, 9 aa, Homo sapiens
YPDVQTRVQ

SEQ ID NO: 1619 - protein, 9 aa, Homo sapiens
PNEPAKMNF

SEQ ID NO: 1620 - protein, 9 aa, Homo sapiens
NHDPLKWPN

SEQ ID NO: 1621 - protein, 9 aa, Homo sapiens
PKDTVVFVN

SEQ ID NO: 1622 - protein, 9 aa, Homo sapiens
ELDQVVGRD

SEQ ID NO: 1623 - protein, 9 aa, Homo sapiens
NEEFGRTVG

SEQ ID NO: 1624 - protein, 9 aa, Homo sapiens
QTTLLLLLS

SEQ ID NO: 1625 - protein, 9 aa, Homo sapiens
DSAVQNLQA

SEQ ID NO: 1626 - protein, 9 aa, Homo sapiens
DKDGLINKD

SEQ ID NO: 1627 - protein, 9 aa, Homo sapiens
DLENVPATI

SEQ ID NO: 1628 - protein, 9 aa, Homo sapiens
SHDDPEFRE

SEQ ID NO: 1629 - protein, 9 aa, Homo sapiens
VHVGQRLLR

SEQ ID NO: 1630 - protein, 9 aa, Homo sapiens
LLDSAVQNL

SEQ ID NO: 1631 - protein, 9 aa, Homo sapiens
SMELLDSAV

SEQ ID NO: 1632 - protein, 9 aa, Homo sapiens
FSYGLTIKP

SEQ ID NO: 1633 - protein, 9 aa, Homo sapiens
LTSRVMIFS

SEQ ID NO: 1634 - protein, 9 aa, Homo sapiens
SFVPVTIPH

SEQ ID NO: 1635 - protein, 9 aa, Homo sapiens
PNLPYVLAF

SEQ ID NO: 1636 - protein, 9 aa, Homo sapiens
DTLSTALQW

SEQ ID NO: 1637 - protein, 9 aa, Homo sapiens
SQDTLSTAL

SEQ ID NO: 1638 - protein, 9 aa, Homo sapiens
RLDLENVPA

SEQ ID NO: 1639 - protein, 9 aa, Homo sapiens
AGDSHGGGA

SEQ ID NO: 1640 - protein, 9 aa, Homo sapiens
SAEKKAAGD

SEQ ID NO: 1641 - protein, 9 aa, Homo sapiens
LVDVMPWLQ

SEQ ID NO: 1642 - protein, 9 aa, Homo sapiens
FADRPAFAS

SEQ ID NO: 1643 - protein, 9 aa, Homo sapiens
TTLLLLLSV

SEQ ID NO: 1644 - protein, 9 aa, Homo sapiens
SKMQLFLFI

SEQ ID NO: 1645 - protein, 9 aa, Homo sapiens
IGEELSKMQ

SEQ ID NO: 1646 - protein, 9 aa, Homo sapiens
NKDLTSRVM

SEQ ID NO: 1647 - protein, 9 aa, Homo sapiens
VTIPHATTA

SEQ ID NO: 1648 - protein, 9 aa, Homo sapiens
LYEAMRFSS

SEQ ID NO: 1649 - protein, 9 aa, Homo sapiens
GRDRLPCMG

SEQ ID NO: 1650 - protein, 9 aa, Homo sapiens
QAELDQVVG

SEQ ID NO: 1651 - protein, 9 aa, Homo sapiens
HCESLRPGA

SEQ ID NO: 1652 - protein, 9 aa, Homo sapiens
ILDKFLRHC

SEQ ID NO: 1653 - protein, 9 aa, Homo sapiens
EFEQLNRNF

SEQ ID NO: 1654 - protein, 9 aa, Homo sapiens
HNEEFGRTV

SEQ ID NO: 1655 - protein, 9 aa, Homo sapiens
FRELLSHNE

SEQ ID NO: 1656 - protein, 9 aa, Homo sapiens
SCPIVVLNG

SEQ ID NO: 1657 - protein, 9 aa, Homo sapiens
GSCPIVVLN

SEQ ID NO: 1658 - protein, 9 aa, Homo sapiens
QCDFRANPN

SEQ ID NO: 1659 - protein, 9 aa, Homo sapiens
GEELSKMQL

SEQ ID NO: 1660 - protein, 9 aa, Homo sapiens
FDPARFLDK

SEQ ID NO: 1661 - protein, 9 aa, Homo sapiens
NPENFDPAR

SEQ ID NO: 1662 - protein, 9 aa, Homo sapiens
SVNHDPLKW

SEQ ID NO: 1663 - protein, 9 aa, Homo sapiens
QTRVQAELD

SEQ ID NO: 1664 - protein, 9 aa, Homo sapiens
ALQWLLLLF

SEQ ID NO: 1665 - protein, 9 aa, Homo sapiens
PRDMMDAFI

SEQ ID NO: 1666 - protein, 9 aa, Homo sapiens
FILDKFLRH

SEQ ID NO: 1667 - protein, 9 aa, Homo sapiens
RTVGAGSLV

SEQ ID NO: 1668 - protein, 9 aa, Homo sapiens
NGERAIHQA

SEQ ID NO: 1669 - protein, 9 aa, Homo sapiens
RSAPPGPFA

SEQ ID NO: 1670 - protein, 9 aa, Homo sapiens
ATVHVGQRL

SEQ ID NO: 1671 - protein, 9 aa, Homo sapiens
SIQQTTLLL

SEQ ID NO: 1672 - protein, 9 aa, Homo sapiens
FKVNVTLRE

SEQ ID NO: 1673 - protein, 9 aa, Homo sapiens
PYVLAFLYE

SEQ ID NO: 1674 - protein, 9 aa, Homo sapiens
DMMDAFILS

SEQ ID NO: 1675 - protein, 9 aa, Homo sapiens
SLRPGAAPR

SEQ ID NO: 1676 - protein, 9 aa, Homo sapiens
RNFSNFILD

SEQ ID NO: 1677 - protein, 9 aa, Homo sapiens
FPNPVRTVF

SEQ ID NO: 1678 - protein, 9 aa, Homo sapiens
TVGAGSLVD

SEQ ID NO: 1679 - protein, 9 aa, Homo sapiens
PRSRQVLEG

SEQ ID NO: 1680 - protein, 9 aa, Homo sapiens
FTRQPRSRQ

SEQ ID NO: 1681 - protein, 9 aa, Homo sapiens
RAIHQALVQ

SEQ ID NO: 1682 - protein, 9 aa, Homo sapiens
PLNPLSIQQ

SEQ ID NO: 1683 - protein, 9 aa, Homo sapiens
MNFSYGLTI

SEQ ID NO: 1684 - protein, 9 aa, Homo sapiens
FLFISILAH

SEQ ID NO: 1685 - protein, 9 aa, Homo sapiens
LSKMQLFLF

SEQ ID NO: 1686 - protein, 9 aa, Homo sapiens
SVLGYHIPK

SEQ ID NO: 1687 - protein, 9 aa, Homo sapiens
TTANTSVLG

SEQ ID NO: 1688 - protein, 9 aa, Homo sapiens
ATTANTSVL

SEQ ID NO: 1689 - protein, 9 aa, Homo sapiens
SSFVPVTIP

SEQ ID NO: 1690 - protein, 9 aa, Homo sapiens
VVGRDRLPC

SEQ ID NO: 1691 - protein, 9 aa, Homo sapiens
FTRYPDVQT

SEQ ID NO: 1692 - protein, 9 aa, Homo sapiens
TALQWLLLL

SEQ ID NO: 1693 - protein, 9 aa, Homo sapiens
ENVPATITD

SEQ ID NO: 1694 - protein, 9 aa, Homo sapiens
HGGGARLDL

SEQ ID NO: 1695 - protein, 9 aa, Homo sapiens
DSHGGGARL

SEQ ID NO: 1696 - protein, 9 aa, Homo sapiens
GSADGAFLD

SEQ ID NO: 1697 - protein, 9 aa, Homo sapiens
ASFRVVSGG

SEQ ID NO: 1698 - protein, 9 aa, Homo sapiens
ADRPAFASF

SEQ ID NO: 1699 - protein, 9 aa, Homo sapiens
HLSFARLAR

SEQ ID NO: 1700 - protein, 9 aa, Homo sapiens
SAPPGPFAW

SEQ ID NO: 1701 - protein, 9 aa, Homo sapiens
LLLLSVLAT

SEQ ID NO: 1702 - protein, 9 aa, Homo sapiens
QQTTLLLLL

SEQ ID NO: 1703 - protein, 9 aa, Homo sapiens
IQQTTLLLL

SEQ ID NO: 1704 - protein, 9 aa, Homo sapiens
LSIQQTTLL

SEQ ID NO: 1705 - protein, 9 aa, Homo sapiens
VTLRESMEL

SEQ ID NO: 1706 - protein, 9 aa, Homo sapiens
KSFKVNVTL

SEQ ID NO: 1707 - protein, 9 aa, Homo sapiens
LTIKPKSFK

SEQ ID NO: 1708 - protein, 9 aa, Homo sapiens
MQLFLFISI

SEQ ID NO: 1709 - protein, 9 aa, Homo sapiens
ELSKMQLFL

SEQ ID NO: 1710 - protein, 9 aa, Homo sapiens
RCIGEELSK

SEQ ID NO: 1711 - protein, 9 aa, Homo sapiens
FSVGKRRCI

SEQ ID NO: 1712 - protein, 9 aa, Homo sapiens
GLINKDLTS

SEQ ID NO: 1713 - protein, 9 aa, Homo sapiens
DTVVFVNQW

SEQ ID NO: 1714 - protein, 9 aa, Homo sapiens
YHIPKDTVV

SEQ ID NO: 1715 - protein, 9 aa, Homo sapiens
NTSVLGYHI

SEQ ID NO: 1716 - protein, 9 aa, Homo sapiens
FSSFVPVTI

SEQ ID NO: 1717 - protein, 9 aa, Homo sapiens
ATITDIFGA

SEQ ID NO: 1718 - protein, 9 aa, Homo sapiens
SHGGGARLD

SEQ ID NO: 1719 - protein, 9 aa, Homo sapiens
FSNFILDKF

SEQ ID NO: 1720 - protein, 9 aa, Homo sapiens
MSAVCFGCR

SEQ ID NO: 1721 - protein, 9 aa, Homo sapiens
LTVVAVANV

SEQ ID NO: 1722 - protein, 9 aa, Homo sapiens
RELVALLVR

SEQ ID NO: 1723 - protein, 9 aa, Homo sapiens
DVFQIRLGS

SEQ ID NO: 1724 - protein, 9 aa, Homo sapiens
VGQAAHLSF

SEQ ID NO: 1725 - protein, 9 aa, Homo sapiens
DPWPLNPLS

SEQ ID NO: 1726 - protein, 9 aa, Homo sapiens
SLSPNDPWP

SEQ ID NO: 1727 - protein, 9 aa, Homo sapiens
RESMELLDS

SEQ ID NO: 1728 - protein, 9 aa, Homo sapiens
TIKPKSFKV

SEQ ID NO: 1729 - protein, 9 aa, Homo sapiens
LFLFISILA

SEQ ID NO: 1730 - protein, 9 aa, Homo sapiens
SRVMIFSVG

SEQ ID NO: 1731 - protein, 9 aa, Homo sapiens
LDKDGLINK

SEQ ID NO: 1732 - protein, 9 aa, Homo sapiens
WSVNHDPLK

SEQ ID NO: 1733 - protein, 9 aa, Homo sapiens
TSVLGYHIP

SEQ ID NO: 1734 - protein, 9 aa, Homo sapiens
TRVQAELDQ

SEQ ID NO: 1735 - protein, 9 aa, Homo sapiens
LQWLLLLFT

SEQ ID NO: 1736 - protein, 9 aa, Homo sapiens
LSTALQWLL

SEQ ID NO: 1737 - protein, 9 aa, Homo sapiens
GASQDTLST

SEQ ID NO: 1738 - protein, 9 aa, Homo sapiens
GGARLDLEN

SEQ ID NO: 1739 - protein, 9 aa, Homo sapiens
ESLRPGAAP

SEQ ID NO: 1740 - protein, 9 aa, Homo sapiens
LRHCESLRP

SEQ ID NO: 1741 - protein, 9 aa, Homo sapiens
NFSNFILDK

SEQ ID NO: 1742 - protein, 9 aa, Homo sapiens
RTVFREFEQ

SEQ ID NO: 1743 - protein, 9 aa, Homo sapiens
PEFRELLSH

SEQ ID NO: 1744 - protein, 9 aa, Homo sapiens
YSHDDPEFR

SEQ ID NO: 1745 - protein, 9 aa, Homo sapiens
RSRQVLEGH

SEQ ID NO: 1746 - protein, 9 aa, Homo sapiens
VSGGRSMAF

SEQ ID NO: 1747 - protein, 9 aa, Homo sapiens
VVSGGRSMA

SEQ ID NO: 1748 - protein, 9 aa, Homo sapiens
RLGSCPIVV

SEQ ID NO: 1749 - protein, 9 aa, Homo sapiens
GPFAWPLIG

SEQ ID NO: 1750 - protein, 9 aa, Homo sapiens
APPGPFAWP

SEQ ID NO: 1751 - protein, 9 aa, Homo sapiens
RQRRRQLRS

SEQ ID NO: 1752 - protein, 9 aa, Homo sapiens
HVGQRLLRQ

SEQ ID NO: 1753 - protein, 9 aa, Homo sapiens
PWPLNPLSI

SEQ ID NO: 1754 - protein, 9 aa, Homo sapiens
TSLSPNDPW

SEQ ID NO: 1755 - protein, 9 aa, Homo sapiens
GTSLSPNDP

SEQ ID NO: 1756 - protein, 9 aa, Homo sapiens
SFKVNVTLR

SEQ ID NO: 1757 - protein, 9 aa, Homo sapiens
VGKRRCIGE

SEQ ID NO: 1758 - protein, 9 aa, Homo sapiens
WPNPENFDP

SEQ ID NO: 1759 - protein, 9 aa, Homo sapiens
KDTVVFVNQ

SEQ ID NO: 1760 - protein, 9 aa, Homo sapiens
YEAMRFSSF

SEQ ID NO: 1761 - protein, 9 aa, Homo sapiens
TRYPDVQTR

SEQ ID NO: 1762 - protein, 9 aa, Homo sapiens
ASQDTLSTA

SEQ ID NO: 1763 - protein, 9 aa, Homo sapiens
FGASQDTLS

SEQ ID NO: 1764 - protein, 9 aa, Homo sapiens
GAAPRDMMD

SEQ ID NO: 1765 - protein, 9 aa, Homo sapiens
PVRTVFREF

SEQ ID NO: 1766 - protein, 9 aa, Homo sapiens
SLVDVMPWL

SEQ ID NO: 1767 - protein, 9 aa, Homo sapiens
GSLVDVMPW

SEQ ID NO: 1768 - protein, 9 aa, Homo sapiens
SHNEEFGRT

SEQ ID NO: 1769 - protein, 9 aa, Homo sapiens
DPRPLTVVA

SEQ ID NO: 1770 - protein, 9 aa, Homo sapiens
AFLDPRPLT

SEQ ID NO: 1771 - protein, 9 aa, Homo sapiens
VLSEARELV

SEQ ID NO: 1772 - protein, 9 aa, Homo sapiens
SMMRNFFTR

SEQ ID NO: 1773 - protein, 9 aa, Homo sapiens
HSMMRNFFT

SEQ ID NO: 1774 - protein, 9 aa, Homo sapiens
RSMAFGHYS

SEQ ID NO: 1775 - protein, 9 aa, Homo sapiens
ALVQQGSAF

SEQ ID NO: 1776 - protein, 9 aa, Homo sapiens
RYGDVFQIR

SEQ ID NO: 1777 - protein, 9 aa, Homo sapiens
FAWPLIGNA

SEQ ID NO: 1778 - protein, 9 aa, Homo sapiens
PFAWPLIGN

SEQ ID NO: 1779 - protein, 9 aa, Homo sapiens
SPNDPWPLN

SEQ ID NO: 1780 - protein, 9 aa, Homo sapiens
LDSAVQNLQ

SEQ ID NO: 1781 - protein, 9 aa, Homo sapiens
ESMELLDSA

SEQ ID NO: 1782 - protein, 9 aa, Homo sapiens
IKPKSFKVN

SEQ ID NO: 1783 - protein, 9 aa, Homo sapiens
YGLTIKPKS

SEQ ID NO: 1784 - protein, 9 aa, Homo sapiens
RANPNEPAK

SEQ ID NO: 1785 - protein, 9 aa, Homo sapiens
AHQCDFRAN

SEQ ID NO: 1786 - protein, 9 aa, Homo sapiens
ISILAHQCD

SEQ ID NO: 1787 - protein, 9 aa, Homo sapiens
RRCIGEELS

SEQ ID NO: 1788 - protein, 9 aa, Homo sapiens
VMIFSVGKR

SEQ ID NO: 1789 - protein, 9 aa, Homo sapiens
TSRVMIFSV

SEQ ID NO: 1790 - protein, 9 aa, Homo sapiens
LKWPNPENF

SEQ ID NO: 1791 - protein, 9 aa, Homo sapiens
VFVNQWSVN

SEQ ID NO: 1792 - protein, 9 aa, Homo sapiens
VLGYHIPKD

SEQ ID NO: 1793 - protein, 9 aa, Homo sapiens
GDQPNLPYV

SEQ ID NO: 1794 - protein, 9 aa, Homo sapiens
CMGDQPNLP

SEQ ID NO: 1795 - protein, 9 aa, Homo sapiens
DRLPCMGDQ

SEQ ID NO: 1796 - protein, 9 aa, Homo sapiens
AELDQVVGR

SEQ ID NO: 1797 - protein, 9 aa, Homo sapiens
PATITDIFG

SEQ ID NO: 1798 - protein, 9 aa, Homo sapiens
LSAEKKAAG

SEQ ID NO: 1799 - protein, 9 aa, Homo sapiens
FLRHCESLR

SEQ ID NO: 1800 - protein, 9 aa, Homo sapiens
QLNRNFSNF

SEQ ID NO: 1801 - protein, 9 aa, Homo sapiens
YFPNPVRTV

SEQ ID NO: 1802 - protein, 9 aa, Homo sapiens
QYFPNPVRT

SEQ ID NO: 1803 - protein, 9 aa, Homo sapiens
PWLQYFPNP

SEQ ID NO: 1804 - protein, 9 aa, Homo sapiens
DVMPWLQYF

SEQ ID NO: 1805 - protein, 9 aa, Homo sapiens
AGSLVDVMP

SEQ ID NO: 1806 - protein, 9 aa, Homo sapiens
FGRTVGAGS

SEQ ID NO: 1807 - protein, 9 aa, Homo sapiens
LSHNEEFGR

SEQ ID NO: 1808 - protein, 9 aa, Homo sapiens
RPLTVVAVA

SEQ ID NO: 1809 - protein, 9 aa, Homo sapiens
VALLVRGSA

SEQ ID NO: 1810 - protein, 9 aa, Homo sapiens
QVLEGHVLS

SEQ ID NO: 1811 - protein, 9 aa, Homo sapiens
TRQPRSRQV

SEQ ID NO: 1812 - protein, 9 aa, Homo sapiens
SMAFGHYSE

SEQ ID NO: 1813 - protein, 9 aa, Homo sapiens
SFRVVSGGR

SEQ ID NO: 1814 - protein, 9 aa, Homo sapiens
PAFASFRVV

SEQ ID NO: 1815 - protein, 9 aa, Homo sapiens
GSAFADRPA

SEQ ID NO: 1816 - protein, 9 aa, Homo sapiens
LNGERAIHQ

SEQ ID NO: 1817 - protein, 9 aa, Homo sapiens
VLNGERAIH

SEQ ID NO: 1818 - protein, 9 aa, Homo sapiens
GDVFQIRLG

SEQ ID NO: 1819 - protein, 9 aa, Homo sapiens
LSFARLARR

SEQ ID NO: 1820 - protein, 9 aa, Homo sapiens
AAHLSFARL

SEQ ID NO: 1821 - protein, 9 aa, Homo sapiens
AAVGQAAHL

SEQ ID NO: 1822 - protein, 9 aa, Homo sapiens
PPGPFAWPL

SEQ ID NO: 1823 - protein, 9 aa, Homo sapiens
RLLRQRRRQ

SEQ ID NO: 1824 - protein, 9 aa, Homo sapiens
TVHVGQRLL

SEQ ID NO: 1825 - protein, 9 aa, Homo sapiens
VLATVHVGQ

SEQ ID NO: 1826 - protein, 9 aa, Homo sapiens
SVLATVHVG

SEQ ID NO: 1827 - protein, 9 aa, Homo sapiens
LSVLATVHV

SEQ ID NO: 1828 - protein, 9 aa, Homo sapiens
LSPNDPWPL

SEQ ID NO: 1829 - protein, 9 aa, Homo sapiens
VQNLQAKET

SEQ ID NO: 1830 - protein, 9 aa, Homo sapiens
AVQNLQAKE

SEQ ID NO: 1831 - protein, 9 aa, Homo sapiens
TLRESMELL

SEQ ID NO: 1832 - protein, 9 aa, Homo sapiens
PAKMNFSYG

SEQ ID NO: 1833 - protein, 9 aa, Homo sapiens
ANPNEPAKM

SEQ ID NO: 1834 - protein, 9 aa, Homo sapiens
FRANPNEPA

SEQ ID NO: 1835 - protein, 9 aa, Homo sapiens
ILAHQCDFR

SEQ ID NO: 1836 - protein, 9 aa, Homo sapiens
SVGKRRCIG

SEQ ID NO: 1837 - protein, 9 aa, Homo sapiens
MIFSVGKRR

SEQ ID NO: 1838 - protein, 9 aa, Homo sapiens
PNPENFDPA

SEQ ID NO: 1839 - protein, 9 aa, Homo sapiens
PLKWPNPEN

SEQ ID NO: 1840 - protein, 9 aa, Homo sapiens
NQWSVNHDP

SEQ ID NO: 1841 - protein, 9 aa, Homo sapiens
TVVFVNQWS

SEQ ID NO: 1842 - protein, 9 aa, Homo sapiens
ANTSVLGYH

SEQ ID NO: 1843 - protein, 9 aa, Homo sapiens
MRFSSFVPV

SEQ ID NO: 1844 - protein, 9 aa, Homo sapiens
NLPYVLAFL

SEQ ID NO: 1845 - protein, 9 aa, Homo sapiens
QPNLPYVLA

SEQ ID NO: 1846 - protein, 9 aa, Homo sapiens
QVVGRDRLP

SEQ ID NO: 1847 - protein, 9 aa, Homo sapiens
DQVVGRDRL

SEQ ID NO: 1848 - protein, 9 aa, Homo sapiens
LDQVVGRDR

SEQ ID NO: 1849 - protein, 9 aa, Homo sapiens
VQTRVQAEL

SEQ ID NO: 1850 - protein, 9 aa, Homo sapiens
TITDIFGAS

SEQ ID NO: 1851 - protein, 9 aa, Homo sapiens
GDSHGGGAR

SEQ ID NO: 1852 - protein, 9 aa, Homo sapiens
FILSAEKKA

SEQ ID NO: 1853 - protein, 9 aa, Homo sapiens
AFILSAEKK

SEQ ID NO: 1854 - protein, 9 aa, Homo sapiens
PGAAPRDMM

SEQ ID NO: 1855 - protein, 9 aa, Homo sapiens
VFREFEQLN

SEQ ID NO: 1856 - protein, 9 aa, Homo sapiens
TVFREFEQL

SEQ ID NO: 1857 - protein, 9 aa, Homo sapiens
LQYFPNPVR

SEQ ID NO: 1858 - protein, 9 aa, Homo sapiens
DDPEFRELL

SEQ ID NO: 1859 - protein, 9 aa, Homo sapiens
VCFGCRYSH

SEQ ID NO: 1860 - protein, 9 aa, Homo sapiens
AVCFGCRYS

SEQ ID NO: 1861 - protein, 9 aa, Homo sapiens
VMSAVCFGC

SEQ ID NO: 1862 - protein, 9 aa, Homo sapiens
AVANVMSAV

SEQ ID NO: 1863 - protein, 9 aa, Homo sapiens
VVAVANVMS

SEQ ID NO: 1864 - protein, 9 aa, Homo sapiens
TVVAVANVM

SEQ ID NO: 1865 - protein, 9 aa, Homo sapiens
PLTVVAVAN

SEQ ID NO: 1866 - protein, 9 aa, Homo sapiens
LLVRGSADG

SEQ ID NO: 1867 - protein, 9 aa, Homo sapiens
ALLVRGSAD

SEQ ID NO: 1868 - protein, 9 aa, Homo sapiens
EARELVALL

SEQ ID NO: 1869 - protein, 9 aa, Homo sapiens
FFTRQPRSR

SEQ ID NO: 1870 - protein, 9 aa, Homo sapiens
MMRNFFTRQ

SEQ ID NO: 1871 - protein, 9 aa, Homo sapiens
HWKVQRRAA

SEQ ID NO: 1872 - protein, 9 aa, Homo sapiens
SEHWKVQRR

SEQ ID NO: 1873 - protein, 9 aa, Homo sapiens
RVVSGGRSM

SEQ ID NO: 1874 - protein, 9 aa, Homo sapiens
AFASFRVVS

SEQ ID NO: 1875 - protein, 9 aa, Homo sapiens
SAFADRPAF

SEQ ID NO: 1876 - protein, 9 aa, Homo sapiens
QQGSAFADR

SEQ ID NO: 1877 - protein, 9 aa, Homo sapiens
VVLNGERAI

SEQ ID NO: 1878 - protein, 9 aa, Homo sapiens
ARRYGDVFQ

SEQ ID NO: 1879 - protein, 9 aa, Homo sapiens
LARRYGDVF

SEQ ID NO: 1880 - protein, 9 aa, Homo sapiens
AHLSFARLA

SEQ ID NO: 1881 - protein, 9 aa, Homo sapiens
AVGQAAHLS

SEQ ID NO: 1882 - protein, 9 aa, Homo sapiens
AAAVGQAAH

SEQ ID NO: 1883 - protein, 9 aa, Homo sapiens
NAAAVGQAA

SEQ ID NO: 1884 - protein, 9 aa, Homo sapiens
WPLIGNAAA

SEQ ID NO: 1885 - protein, 9 aa, Homo sapiens
LRQRRRQLR

SEQ ID NO: 1886 - protein, 9 aa, Homo sapiens
LLLSVLATV

SEQ ID NO: 1887 - protein, 9 aa, Homo sapiens
LLLLLSVLA

SEQ ID NO: 1888 - protein, 9 aa, Homo sapiens
PLSIQQTTL

SEQ ID NO: 1889 - protein, 9 aa, Homo sapiens
SAVQNLQAK

SEQ ID NO: 1890 - protein, 9 aa, Homo sapiens
VNVTLRESM

SEQ ID NO: 1891 - protein, 9 aa, Homo sapiens
PKSFKVNVT

SEQ ID NO: 1892 - protein, 9 aa, Homo sapiens
SYGLTIKPK

SEQ ID NO: 1893 - protein, 9 aa, Homo sapiens
NFSYGLTIK

SEQ ID NO: 1894 - protein, 9 aa, Homo sapiens
KMNFSYGLT

SEQ ID NO: 1895 - protein, 9 aa, Homo sapiens
NPNEPAKMN

SEQ ID NO: 1896 - protein, 9 aa, Homo sapiens
SILAHQCDF

SEQ ID NO: 1897 - protein, 9 aa, Homo sapiens
EELSKMQLF

SEQ ID NO: 1898 - protein, 9 aa, Homo sapiens
CIGEELSKM

SEQ ID NO: 1899 - protein, 9 aa, Homo sapiens
IFSVGKRRC

SEQ ID NO: 1900 - protein, 9 aa, Homo sapiens
DLTSRVMIF

SEQ ID NO: 1901 - protein, 9 aa, Homo sapiens
KDLTSRVMI

SEQ ID NO: 1902 - protein, 9 aa, Homo sapiens
DGLINKDLT

SEQ ID NO: 1903 - protein, 9 aa, Homo sapiens
RFLDKDGLI

SEQ ID NO: 1904 - protein, 9 aa, Homo sapiens
DPARFLDKD

SEQ ID NO: 1905 - protein, 9 aa, Homo sapiens
VNHDPLKWP

SEQ ID NO: 1906 - protein, 9 aa, Homo sapiens
VNQWSVNHD

SEQ ID NO: 1907 - protein, 9 aa, Homo sapiens
RFSSFVPVT

SEQ ID NO: 1908 - protein, 9 aa, Homo sapiens
AMRFSSFVP

SEQ ID NO: 1909 - protein, 9 aa, Homo sapiens
FLYEAMRFS

SEQ ID NO: 1910 - protein, 9 aa, Homo sapiens
LAFLYEAMR

SEQ ID NO: 1911 - protein, 9 aa, Homo sapiens
VLAFLYEAM

SEQ ID NO: 1912 - protein, 9 aa, Homo sapiens
YVLAFLYEA

SEQ ID NO: 1913 - protein, 9 aa, Homo sapiens
LPCMGDQPN

SEQ ID NO: 1914 - protein, 9 aa, Homo sapiens
RLPCMGDQP

SEQ ID NO: 1915 - protein, 9 aa, Homo sapiens
VQAELDQVV

SEQ ID NO: 1916 - protein, 9 aa, Homo sapiens
RYPDVQTRV

SEQ ID NO: 1917 - protein, 9 aa, Homo sapiens
LFTRYPDVQ

SEQ ID NO: 1918 - protein, 9 aa, Homo sapiens
LLLFTRYPD

SEQ ID NO: 1919 - protein, 9 aa, Homo sapiens
QDTLSTALQ

SEQ ID NO: 1920 - protein, 9 aa, Homo sapiens
TDIFGASQD

SEQ ID NO: 1921 - protein, 9 aa, Homo sapiens
ARLDLENVP

SEQ ID NO: 1922 - protein, 9 aa, Homo sapiens
GGGARLDLE

SEQ ID NO: 1923 - protein, 9 aa, Homo sapiens
KKAAGDSHG

SEQ ID NO: 1924 - protein, 9 aa, Homo sapiens
NFILDKFLR

SEQ ID NO: 1925 - protein, 9 aa, Homo sapiens
SNFILDKFL

SEQ ID NO: 1926 - protein, 9 aa, Homo sapiens
FEQLNRNFS

SEQ ID NO: 1927 - protein, 9 aa, Homo sapiens
REFEQLNRN

SEQ ID NO: 1928 - protein, 9 aa, Homo sapiens
VRTVFREFE

SEQ ID NO: 1929 - protein, 9 aa, Homo sapiens
MPWLQYFPN

SEQ ID NO: 1930 - protein, 9 aa, Homo sapiens
GAGSLVDVM

SEQ ID NO: 1931 - protein, 9 aa, Homo sapiens
VGAGSLVDV

SEQ ID NO: 1932 - protein, 9 aa, Homo sapiens
GRTVGAGSL

SEQ ID NO: 1933 - protein, 9 aa, Homo sapiens
ELLSHNEEF

SEQ ID NO: 1934 - protein, 9 aa, Homo sapiens
FGCRYSHDD

SEQ ID NO: 1935 - protein, 9 aa, Homo sapiens
VANVMSAVC

SEQ ID NO: 1936 - protein, 9 aa, Homo sapiens
VAVANVMSA

SEQ ID NO: 1937 - protein, 9 aa, Homo sapiens
LDPRPLTVV

SEQ ID NO: 1938 - protein, 9 aa, Homo sapiens
SEARELVAL

SEQ ID NO: 1939 - protein, 9 aa, Homo sapiens
LEGHVLSEA

SEQ ID NO: 1940 - protein, 9 aa, Homo sapiens
RQVLEGHVL

SEQ ID NO: 1941 - protein, 9 aa, Homo sapiens
SRQVLEGHV

SEQ ID NO: 1942 - protein, 9 aa, Homo sapiens
QPRSRQVLE

SEQ ID NO: 1943 - protein, 9 aa, Homo sapiens
RQPRSRQVL

SEQ ID NO: 1944 - protein, 9 aa, Homo sapiens
AHSMMRNFF

SEQ ID NO: 1945 - protein, 9 aa, Homo sapiens
EHWKVQRRA

SEQ ID NO: 1946 - protein, 9 aa, Homo sapiens
GHYSEHWKV

SEQ ID NO: 1947 - protein, 9 aa, Homo sapiens
AFGHYSEHW

SEQ ID NO: 1948 - protein, 9 aa, Homo sapiens
SGGRSMAFG

SEQ ID NO: 1949 - protein, 9 aa, Homo sapiens
FRVVSGGRS

SEQ ID NO: 1950 - protein, 9 aa, Homo sapiens
FASFRVVSG

SEQ ID NO: 1951 - protein, 9 aa, Homo sapiens
VQQGSAFAD

SEQ ID NO: 1952 - protein, 9 aa, Homo sapiens
LVQQGSAFA

SEQ ID NO: 1953 - protein, 9 aa, Homo sapiens
QALVQQGSA

SEQ ID NO: 1954 - protein, 9 aa, Homo sapiens
HQALVQQGS

SEQ ID NO: 1955 - protein, 9 aa, Homo sapiens
ERAIHQALV

SEQ ID NO: 1956 - protein, 9 aa, Homo sapiens
CPIVVLNGE

SEQ ID NO: 1957 - protein, 9 aa, Homo sapiens
LGSCPIVVL

SEQ ID NO: 1958 - protein, 9 aa, Homo sapiens
QIRLGSCPI

SEQ ID NO: 1959 - protein, 9 aa, Homo sapiens
FQIRLGSCP

SEQ ID NO: 1960 - protein, 9 aa, Homo sapiens
RRYGDVFQI

SEQ ID NO: 1961 - protein, 9 aa, Homo sapiens
ARLARRYGD

SEQ ID NO: 1962 - protein, 9 aa, Homo sapiens
FARLARRYG

SEQ ID NO: 1963 - protein, 9 aa, Homo sapiens
PLIGNAAAV

SEQ ID NO: 1964 - protein, 9 aa, Homo sapiens
AWPLIGNAA

SEQ ID NO: 1965 - protein, 9 aa, Homo sapiens
PGPFAWPLI

SEQ ID NO: 1966 - protein, 9 aa, Homo sapiens
QRRRQLRSA

SEQ ID NO: 1967 - protein, 9 aa, Homo sapiens
LLRQRRRQL

SEQ ID NO: 1968 - protein, 9 aa, Homo sapiens
LLSVLATVH

SEQ ID NO: 1969 - protein, 9 aa, Homo sapiens
TLLLLLSVL

SEQ ID NO: 1970 - protein, 9 aa, Homo sapiens
NLQAKETCQ

SEQ ID NO: 1971 - protein, 9 aa, Homo sapiens
ELLDSAVQN

SEQ ID NO: 1972 - protein, 9 aa, Homo sapiens
MELLDSAVQ

SEQ ID NO: 1973 - protein, 9 aa, Homo sapiens
NVTLRESME

SEQ ID NO: 1974 - protein, 9 aa, Homo sapiens
GLTIKPKSF

SEQ ID NO: 1975 - protein, 9 aa, Homo sapiens
AKMNFSYGL

SEQ ID NO: 1976 - protein, 9 aa, Homo sapiens
CDFRANPNE

SEQ ID NO: 1977 - protein, 9 aa, Homo sapiens
HQCDFRANP

SEQ ID NO: 1978 - protein, 9 aa, Homo sapiens
FISILAHQC

SEQ ID NO: 1979 - protein, 9 aa, Homo sapiens
QLFLFISIL

SEQ ID NO: 1980 - protein, 9 aa, Homo sapiens
KRRCIGEEL

SEQ ID NO: 1981 - protein, 9 aa, Homo sapiens
KDGLINKDL

SEQ ID NO: 1982 - protein, 9 aa, Homo sapiens
ARFLDKDGL

SEQ ID NO: 1983 - protein, 9 aa, Homo sapiens
ENFDPARFL

SEQ ID NO: 1984 - protein, 9 aa, Homo sapiens
KWPNPENFD

SEQ ID NO: 1985 - protein, 9 aa, Homo sapiens
FVNQWSVNH

SEQ ID NO: 1986 - protein, 9 aa, Homo sapiens
VVFVNQWSV

SEQ ID NO: 1987 - protein, 9 aa, Homo sapiens
IPKDTVVFV

SEQ ID NO: 1988 - protein, 9 aa, Homo sapiens
HIPKDTVVF

SEQ ID NO: 1989 - protein, 9 aa, Homo sapiens
GYHIPKDTV

SEQ ID NO: 1990 - protein, 9 aa, Homo sapiens
HATTANTSV

SEQ ID NO: 1991 - protein, 9 aa, Homo sapiens
PVTIPHATT

SEQ ID NO: 1992 - protein, 9 aa, Homo sapiens
VPVTIPHAT

SEQ ID NO: 1993 - protein, 9 aa, Homo sapiens
FVPVTIPHA

SEQ ID NO: 1994 - protein, 9 aa, Homo sapiens
AFLYEAMRF

SEQ ID NO: 1995 - protein, 9 aa, Homo sapiens
DQPNLPYVL

SEQ ID NO: 1996 - protein, 9 aa, Homo sapiens
PCMGDQPNL

SEQ ID NO: 1997 - protein, 9 aa, Homo sapiens
RDRLPCMGD

SEQ ID NO: 1998 - protein, 9 aa, Homo sapiens
VGRDRLPCM

SEQ ID NO: 1999 - protein, 9 aa, Homo sapiens
DVQTRVQAE

SEQ ID NO: 2000 - protein, 9 aa, Homo sapiens
PDVQTRVQA

SEQ ID NO: 2001 - protein, 9 aa, Homo sapiens
LLFTRYPDV

SEQ ID NO: 2002 - protein, 9 aa, Homo sapiens
LLLLFTRYP

SEQ ID NO: 2003 - protein, 9 aa, Homo sapiens
TLSTALQWL

SEQ ID NO: 2004 - protein, 9 aa, Homo sapiens
DIFGASQDT

SEQ ID NO: 2005 - protein, 9 aa, Homo sapiens
VPATITDIF

SEQ ID NO: 2006 - protein, 9 aa, Homo sapiens
LENVPATIT

SEQ ID NO: 2007 - protein, 9 aa, Homo sapiens
LDLENVPAT

SEQ ID NO: 2008 - protein, 9 aa, Homo sapiens
AAGDSHGGG

SEQ ID NO: 2009 - protein, 9 aa, Homo sapiens
KAAGDSHGG

SEQ ID NO: 2010 - protein, 9 aa, Homo sapiens
EKKAAGDSH

SEQ ID NO: 2011 - protein, 9 aa, Homo sapiens
AEKKAAGDS

SEQ ID NO: 2012 - protein, 9 aa, Homo sapiens
ILSAEKKAA

SEQ ID NO: 2013 - protein, 9 aa, Homo sapiens
APRDMMDAF

SEQ ID NO: 2014 - protein, 9 aa, Homo sapiens
AAPRDMMDA

SEQ ID NO: 2015 - protein, 9 aa, Homo sapiens
LRPGAAPRD

SEQ ID NO: 2016 - protein, 9 aa, Homo sapiens
LDKFLRHCE

SEQ ID NO: 2017 - protein, 9 aa, Homo sapiens
NRNFSNFIL

SEQ ID NO: 2018 - protein, 9 aa, Homo sapiens
EQLNRNFSN

SEQ ID NO: 2019 - protein, 9 aa, Homo sapiens
NPVRTVFRE

SEQ ID NO: 2020 - protein, 9 aa, Homo sapiens
WLQYFPNPV

SEQ ID NO: 2021 - protein, 9 aa, Homo sapiens
VMPWLQYFP

SEQ ID NO: 2022 - protein, 9 aa, Homo sapiens
EFGRTVGAG

SEQ ID NO: 2023 - protein, 9 aa, Homo sapiens
EEFGRTVGA

SEQ ID NO: 2024 - protein, 9 aa, Homo sapiens
LLSHNEEFG

SEQ ID NO: 2025 - protein, 9 aa, Homo sapiens
NVMSAVCFG

SEQ ID NO: 2026 - protein, 9 aa, Homo sapiens
ANVMSAVCF

SEQ ID NO: 2027 - protein, 9 aa, Homo sapiens
PRPLTVVAV

SEQ ID NO: 2028 - protein, 9 aa, Homo sapiens
ADGAFLDPR

SEQ ID NO: 2029 - protein, 9 aa, Homo sapiens
RGSADGAFL

SEQ ID NO: 2030 - protein, 9 aa, Homo sapiens
VRGSADGAF

SEQ ID NO: 2031 - protein, 9 aa, Homo sapiens
LVRGSADGA

SEQ ID NO: 2032 - protein, 9 aa, Homo sapiens
LVALLVRGS

SEQ ID NO: 2033 - protein, 9 aa, Homo sapiens
ELVALLVRG

SEQ ID NO: 2034 - protein, 9 aa, Homo sapiens
RNFFTRQPR

SEQ ID NO: 2035 - protein, 9 aa, Homo sapiens
AAHSMMRNF

SEQ ID NO: 2036 - protein, 9 aa, Homo sapiens
RRAAHSMMR

SEQ ID NO: 2037 - protein, 9 aa, Homo sapiens
QRRAAHSMM

SEQ ID NO: 2038 - protein, 9 aa, Homo sapiens
VQRRAAHSM

SEQ ID NO: 2039 - protein, 9 aa, Homo sapiens
WKVQRRAAH

SEQ ID NO: 2040 - protein, 9 aa, Homo sapiens
HYSEHWKVQ

SEQ ID NO: 2041 - protein, 9 aa, Homo sapiens
FGHYSEHWK

SEQ ID NO: 2042 - protein, 9 aa, Homo sapiens
MAFGHYSEH

SEQ ID NO: 2043 - protein, 9 aa, Homo sapiens
AFADRPAFA

SEQ ID NO: 2044 - protein, 9 aa, Homo sapiens
IHQALVQQG

SEQ ID NO: 2045 - protein, 9 aa, Homo sapiens
AIHQALVQQ

SEQ ID NO: 2046 - protein, 9 aa, Homo sapiens
IVVLNGERA

SEQ ID NO: 2047 - protein, 9 aa, Homo sapiens
PIVVLNGER

SEQ ID NO: 2048 - protein, 9 aa, Homo sapiens
IRLGSCPIV

SEQ ID NO: 2049 - protein, 9 aa, Homo sapiens
VFQIRLGSC

SEQ ID NO: 2050 - protein, 9 aa, Homo sapiens
RLARRYGDV

SEQ ID NO: 2051 - protein, 9 aa, Homo sapiens
GNAAAVGQA

SEQ ID NO: 2052 - protein, 9 aa, Homo sapiens
LIGNAAAVG

SEQ ID NO: 2053 - protein, 9 aa, Homo sapiens
LRSAPPGPF

SEQ ID NO: 2054 - protein, 9 aa, Homo sapiens
QLRSAPPGP

SEQ ID NO: 2055 - protein, 9 aa, Homo sapiens
RRRQLRSAP

SEQ ID NO: 2056 - protein, 9 aa, Homo sapiens
GQRLLRQRR

SEQ ID NO: 2057 - protein, 9 aa, Homo sapiens
VGQRLLRQR

SEQ ID NO: 2058 - protein, 9 aa, Homo sapiens
LATVHVGQR

SEQ ID NO: 2059 - protein, 9 aa, Homo sapiens
WPLNPLSIQ

SEQ ID NO: 2060 - protein, 9 aa, Homo sapiens
NDPWPLNPL

SEQ ID NO: 2061 - protein, 10 aa, Homo sapiens
LVDVMPWLQY

SEQ ID NO: 2062 - protein, 10 aa, Homo sapiens
TTANTSVLGY

SEQ ID NO: 2063 - protein, 10 aa, Homo sapiens
NFDPARFLDK

SEQ ID NO: 2064 - protein, 10 aa, Homo sapiens
CMGDQPNLPY

SEQ ID NO: 2065 - protein, 10 aa, Homo sapiens
MSAVCFGCRY

SEQ ID NO: 2066 - protein, 10 aa, Homo sapiens
LSFARLARRY

SEQ ID NO: 2067 - protein, 10 aa, Homo sapiens
NLPYVLAFLY

SEQ ID NO: 2068 - protein, 10 aa, Homo sapiens
QWLLLLFTRY

SEQ ID NO: 2069 - protein, 10 aa, Homo sapiens
ARELVALLVR

SEQ ID NO: 2070 - protein, 10 aa, Homo sapiens
GGRSMAFGHY

SEQ ID NO: 2071 - protein, 10 aa, Homo sapiens
HDDPEFRELL

SEQ ID NO: 2072 - protein, 10 aa, Homo sapiens
FLDPRPLTVV

SEQ ID NO: 2073 - protein, 10 aa, Homo sapiens
YSEHWKVQRR

SEQ ID NO: 2074 - protein, 10 aa, Homo sapiens
LRESMELLDS

SEQ ID NO: 2075 - protein, 10 aa, Homo sapiens
NEPAKMNFSY

SEQ ID NO: 2076 - protein, 10 aa, Homo sapiens
FLDKDGLINK

SEQ ID NO: 2077 - protein, 10 aa, Homo sapiens
STALQWLLLL

SEQ ID NO: 2078 - protein, 10 aa, Homo sapiens
ITDIFGASQD

SEQ ID NO: 2079 - protein, 10 aa, Homo sapiens
DPEFRELLSH

SEQ ID NO: 2080 - protein, 10 aa, Homo sapiens
SHDDPEFREL

SEQ ID NO: 2081 - protein, 10 aa, Homo sapiens
GSCPIVVLNG

SEQ ID NO: 2082 - protein, 10 aa, Homo sapiens
PNEPAKMNFS

SEQ ID NO: 2083 - protein, 10 aa, Homo sapiens
NHDPLKWPNP

SEQ ID NO: 2084 - protein, 10 aa, Homo sapiens
SQDTLSTALQ

SEQ ID NO: 2085 - protein, 10 aa, Homo sapiens
RTVGAGSLVD

SEQ ID NO: 2086 - protein, 10 aa, Homo sapiens
LSEARELVAL

SEQ ID NO: 2087 - protein, 10 aa, Homo sapiens
FADRPAFASF

SEQ ID NO: 2088 - protein, 10 aa, Homo sapiens
YGDVFQIRLG

SEQ ID NO: 2089 - protein, 10 aa, Homo sapiens
PNDPWPLNPL

SEQ ID NO: 2090 - protein, 10 aa, Homo sapiens
LLDSAVQNLQ

SEQ ID NO: 2091 - protein, 10 aa, Homo sapiens
SMELLDSAVQ

SEQ ID NO: 2092 - protein, 10 aa, Homo sapiens
LSKMQLFLFI

SEQ ID NO: 2093 - protein, 10 aa, Homo sapiens
PKDTVVFVNQ

SEQ ID NO: 2094 - protein, 10 aa, Homo sapiens
LYEAMRFSSF

SEQ ID NO: 2095 - protein, 10 aa, Homo sapiens
YPDVQTRVQA

SEQ ID NO: 2096 - protein, 10 aa, Homo sapiens
SADGAFLDPR

SEQ ID NO: 2097 - protein, 10 aa, Homo sapiens
GSADGAFLDP

SEQ ID NO: 2098 - protein, 10 aa, Homo sapiens
VLEGHVLSEA

SEQ ID NO: 2099 - protein, 10 aa, Homo sapiens
GEELSKMQLF

SEQ ID NO: 2100 - protein, 10 aa, Homo sapiens
NKDLTSRVMI

SEQ ID NO: 2101 - protein, 10 aa, Homo sapiens
DKDGLINKDL

SEQ ID NO: 2102 - protein, 10 aa, Homo sapiens
WSVNHDPLKW

SEQ ID NO: 2103 - protein, 10 aa, Homo sapiens
ELDQVVGRDR

SEQ ID NO: 2104 - protein, 10 aa, Homo sapiens
QTRVQAELDQ

SEQ ID NO: 2105 - protein, 10 aa, Homo sapiens
LSTALQWLLL

SEQ ID NO: 2106 - protein, 10 aa, Homo sapiens
RLDLENVPAT

SEQ ID NO: 2107 - protein, 10 aa, Homo sapiens
AGDSHGGGAR

SEQ ID NO: 2108 - protein, 10 aa, Homo sapiens
SAEKKAAGDS

SEQ ID NO: 2109 - protein, 10 aa, Homo sapiens
ILDKFLRHCE

SEQ ID NO: 2110 - protein, 10 aa, Homo sapiens
HNEEFGRTVG

SEQ ID NO: 2111 - protein, 10 aa, Homo sapiens
QTTLLLLLSV

SEQ ID NO: 2112 - protein, 10 aa, Homo sapiens
LSIQQTTLLL

SEQ ID NO: 2113 - protein, 10 aa, Homo sapiens
QCDFRANPNE

SEQ ID NO: 2114 - protein, 10 aa, Homo sapiens
VTIPHATTAN

SEQ ID NO: 2115 - protein, 10 aa, Homo sapiens
QAELDQVVGR

SEQ ID NO: 2116 - protein, 10 aa, Homo sapiens
DLENVPATIT

SEQ ID NO: 2117 - protein, 10 aa, Homo sapiens
EFEQLNRNFS

SEQ ID NO: 2118 - protein, 10 aa, Homo sapiens
FREFEQLNRN

SEQ ID NO: 2119 - protein, 10 aa, Homo sapiens
FRELLSHNEE

SEQ ID NO: 2120 - protein, 10 aa, Homo sapiens
IGEELSKMQL

SEQ ID NO: 2121 - protein, 10 aa, Homo sapiens
NPENFDPARF

SEQ ID NO: 2122 - protein, 10 aa, Homo sapiens
SSFVPVTIPH

SEQ ID NO: 2123 - protein, 10 aa, Homo sapiens
MGDQPNLPYV

SEQ ID NO: 2124 - protein, 10 aa, Homo sapiens
GRDRLPCMGD

SEQ ID NO: 2125 - protein, 10 aa, Homo sapiens
ATITDIFGAS

SEQ ID NO: 2126 - protein, 10 aa, Homo sapiens
SHGGGARLDL

SEQ ID NO: 2127 - protein, 10 aa, Homo sapiens
MMDAFILSAE

SEQ ID NO: 2128 - protein, 10 aa, Homo sapiens
PRDMMDAFIL

SEQ ID NO: 2129 - protein, 10 aa, Homo sapiens
HCESLRPGAA

SEQ ID NO: 2130 - protein, 10 aa, Homo sapiens
NEEFGRTVGA

SEQ ID NO: 2131 - protein, 10 aa, Homo sapiens
NGERAIHQAL

SEQ ID NO: 2132 - protein, 10 aa, Homo sapiens
SIQQTTLLLL

SEQ ID NO: 2133 - protein, 10 aa, Homo sapiens
DPWPLNPLSI

SEQ ID NO: 2134 - protein, 10 aa, Homo sapiens
TLRESMELLD

SEQ ID NO: 2135 - protein, 10 aa, Homo sapiens
VTLRESMELL

SEQ ID NO: 2136 - protein, 10 aa, Homo sapiens
ATTANTSVLG

SEQ ID NO: 2137 - protein, 10 aa, Homo sapiens
LPYVLAFLYE

SEQ ID NO: 2138 - protein, 10 aa, Homo sapiens
RDMMDAFILS

SEQ ID NO: 2139 - protein, 10 aa, Homo sapiens
NFILDKFLRH

SEQ ID NO: 2140 - protein, 10 aa, Homo sapiens
NRNFSNFILD

SEQ ID NO: 2141 - protein, 10 aa, Homo sapiens
RTVFREFEQL

SEQ ID NO: 2142 - protein, 10 aa, Homo sapiens
VLSEARELVA

SEQ ID NO: 2143 - protein, 10 aa, Homo sapiens
SAPPGPFAWP

SEQ ID NO: 2144 - protein, 10 aa, Homo sapiens
TVHVGQRLLR

SEQ ID NO: 2145 - protein, 10 aa, Homo sapiens
ATVHVGQRLL

SEQ ID NO: 2146 - protein, 10 aa, Homo sapiens
SFKVNVTLRE

SEQ ID NO: 2147 - protein, 10 aa, Homo sapiens
TIKPKSFKVN

SEQ ID NO: 2148 - protein, 10 aa, Homo sapiens
LTIKPKSFKV

SEQ ID NO: 2149 - protein, 10 aa, Homo sapiens
TSRVMIFSVG

SEQ ID NO: 2150 - protein, 10 aa, Homo sapiens
TSVLGYHIPK

SEQ ID NO: 2151 - protein, 10 aa, Homo sapiens
QVVGRDRLPC

SEQ ID NO: 2152 - protein, 10 aa, Homo sapiens
FTRYPDVQTR

SEQ ID NO: 2153 - protein, 10 aa, Homo sapiens
ALQWLLLLFT

SEQ ID NO: 2154 - protein, 10 aa, Homo sapiens
TALQWLLLLF

SEQ ID NO: 2155 - protein, 10 aa, Homo sapiens
FLRHCESLRP

SEQ ID NO: 2156 - protein, 10 aa, Homo sapiens
DDPEFRELLS

SEQ ID NO: 2157 - protein, 10 aa, Homo sapiens
EARELVALLV

SEQ ID NO: 2158 - protein, 10 aa, Homo sapiens
AHLSFARLAR

SEQ ID NO: 2159 - protein, 10 aa, Homo sapiens
RSAPPGPFAW

SEQ ID NO: 2160 - protein, 10 aa, Homo sapiens
VHVGQRLLRQ

SEQ ID NO: 2161 - protein, 10 aa, Homo sapiens
LLLLLSVLAT

SEQ ID NO: 2162 - protein, 10 aa, Homo sapiens
QQTTLLLLLS

SEQ ID NO: 2163 - protein, 10 aa, Homo sapiens
IQQTTLLLLL

SEQ ID NO: 2164 - protein, 10 aa, Homo sapiens
SPNDPWPLNP

SEQ ID NO: 2165 - protein, 10 aa, Homo sapiens
LDSAVQNLQA

SEQ ID NO: 2166 - protein, 10 aa, Homo sapiens
KSFKVNVTLR

SEQ ID NO: 2167 - protein, 10 aa, Homo sapiens
KMNFSYGLTI

SEQ ID NO: 2168 - protein, 10 aa, Homo sapiens
QLFLFISILA

SEQ ID NO: 2169 - protein, 10 aa, Homo sapiens
KMQLFLFISI

SEQ ID NO: 2170 - protein, 10 aa, Homo sapiens
FSVGKRRCIG

SEQ ID NO: 2171 - protein, 10 aa, Homo sapiens
RFLDKDGLIN

SEQ ID NO: 2172 - protein, 10 aa, Homo sapiens
WPNPENFDPA

SEQ ID NO: 2173 - protein, 10 aa, Homo sapiens
DTVVFVNQWS

SEQ ID NO: 2174 - protein, 10 aa, Homo sapiens
YHIPKDTVVF

SEQ ID NO: 2175 - protein, 10 aa, Homo sapiens
QPNLPYVLAF

SEQ ID NO: 2176 - protein, 10 aa, Homo sapiens
FGASQDTLST

SEQ ID NO: 2177 - protein, 10 aa, Homo sapiens
DSHGGGARLD

SEQ ID NO: 2178 - protein, 10 aa, Homo sapiens
SLRPGAAPRD

SEQ ID NO: 2179 - protein, 10 aa, Homo sapiens
VFREFEQLNR

SEQ ID NO: 2180 - protein, 10 aa, Homo sapiens
LSHNEEFGRT

SEQ ID NO: 2181 - protein, 10 aa, Homo sapiens
LTVVAVANVM

SEQ ID NO: 2182 - protein, 10 aa, Homo sapiens
AFLDPRPLTV

SEQ ID NO: 2183 - protein, 10 aa, Homo sapiens
QVLEGHVLSE

SEQ ID NO: 2184 - protein, 10 aa, Homo sapiens
QPRSRQVLEG

SEQ ID NO: 2185 - protein, 10 aa, Homo sapiens
FTRQPRSRQV

SEQ ID NO: 2186 - protein, 10 aa, Homo sapiens
HSMMRNFFTR

SEQ ID NO: 2187 - protein, 10 aa, Homo sapiens
ERAIHQALVQ

SEQ ID NO: 2188 - protein, 10 aa, Homo sapiens
VLNGERAIHQ

SEQ ID NO: 2189 - protein, 10 aa, Homo sapiens
GDVFQIRLGS

SEQ ID NO: 2190 - protein, 10 aa, Homo sapiens
AVGQAAHLSF

SEQ ID NO: 2191 - protein, 10 aa, Homo sapiens
TTLLLLLSVL

SEQ ID NO: 2192 - protein, 10 aa, Homo sapiens
SLSPNDPWPL

SEQ ID NO: 2193 - protein, 10 aa, Homo sapiens
GTSLSPNDPW

SEQ ID NO: 2194 - protein, 10 aa, Homo sapiens
FSYGLTIKPK

SEQ ID NO: 2195 - protein, 10 aa, Homo sapiens
NFSYGLTIKP

SEQ ID NO: 2196 - protein, 10 aa, Homo sapiens
RANPNEPAKM

SEQ ID NO: 2197 - protein, 10 aa, Homo sapiens
LFLFISILAH

SEQ ID NO: 2198 - protein, 10 aa, Homo sapiens
EELSKMQLFL

SEQ ID NO: 2199 - protein, 10 aa, Homo sapiens
RRCIGEELSK

SEQ ID NO: 2200 - protein, 10 aa, Homo sapiens
SVGKRRCIGE

SEQ ID NO: 2201 - protein, 10 aa, Homo sapiens
LTSRVMIFSV

SEQ ID NO: 2202 - protein, 10 aa, Homo sapiens
DGLINKDLTS

SEQ ID NO: 2203 - protein, 10 aa, Homo sapiens
NTSVLGYHIP

SEQ ID NO: 2204 - protein, 10 aa, Homo sapiens
SFVPVTIPHA

SEQ ID NO: 2205 - protein, 10 aa, Homo sapiens
FSSFVPVTIP

SEQ ID NO: 2206 - protein, 10 aa, Homo sapiens
DTLSTALQWL

SEQ ID NO: 2207 - protein, 10 aa, Homo sapiens
QDTLSTALQW

SEQ ID NO: 2208 - protein, 10 aa, Homo sapiens
GGGARLDLEN

SEQ ID NO: 2209 - protein, 10 aa, Homo sapiens
DMMDAFILSA

SEQ ID NO: 2210 - protein, 10 aa, Homo sapiens
RNFSNFILDK

SEQ ID NO: 2211 - protein, 10 aa, Homo sapiens
YSHDDPEFRE

SEQ ID NO: 2212 - protein, 10 aa, Homo sapiens
TRQPRSRQVL

SEQ ID NO: 2213 - protein, 10 aa, Homo sapiens
VSGGRSMAFG

SEQ ID NO: 2214 - protein, 10 aa, Homo sapiens
IRLGSCPIVV

SEQ ID NO: 2215 - protein, 10 aa, Homo sapiens
FAWPLIGNAA

SEQ ID NO: 2216 - protein, 10 aa, Homo sapiens
PGPFAWPLIG

SEQ ID NO: 2217 - protein, 10 aa, Homo sapiens
PPGPFAWPLI

SEQ ID NO: 2218 - protein, 10 aa, Homo sapiens
LRQRRRQLRS

SEQ ID NO: 2219 - protein, 10 aa, Homo sapiens
LSVLATVHVG

SEQ ID NO: 2220 - protein, 10 aa, Homo sapiens
LSPNDPWPLN

SEQ ID NO: 2221 - protein, 10 aa, Homo sapiens
DLTSRVMIFS

SEQ ID NO: 2222 - protein, 10 aa, Homo sapiens
SVLGYHIPKD

SEQ ID NO: 2223 - protein, 10 aa, Homo sapiens
GDQPNLPYVL

SEQ ID NO: 2224 - protein, 10 aa, Homo sapiens
DRLPCMGDQP

SEQ ID NO: 2225 - protein, 10 aa, Homo sapiens
ASQDTLSTAL

SEQ ID NO: 2226 - protein, 10 aa, Homo sapiens
VPATITDIFG

SEQ ID NO: 2227 - protein, 10 aa, Homo sapiens
FSNFILDKFL

SEQ ID NO: 2228 - protein, 10 aa, Homo sapiens
FPNPVRTVFR

SEQ ID NO: 2229 - protein, 10 aa, Homo sapiens
QYFPNPVRTV

SEQ ID NO: 2230 - protein, 10 aa, Homo sapiens
SLVDVMPWLQ

SEQ ID NO: 2231 - protein, 10 aa, Homo sapiens
DPRPLTVVAV

SEQ ID NO: 2232 - protein, 10 aa, Homo sapiens
SEARELVALL

SEQ ID NO: 2233 - protein, 10 aa, Homo sapiens
SMMRNFFTRQ

SEQ ID NO: 2234 - protein, 10 aa, Homo sapiens
ASFRVVSGGR

SEQ ID NO: 2235 - protein, 10 aa, Homo sapiens
ADRPAFASFR

SEQ ID NO: 2236 - protein, 10 aa, Homo sapiens
GSAFADRPAF

SEQ ID NO: 2237 - protein, 10 aa, Homo sapiens
VQQGSAFADR

SEQ ID NO: 2238 - protein, 10 aa, Homo sapiens
PLNPLSIQQT

SEQ ID NO: 2239 - protein, 10 aa, Homo sapiens
SAVQNLQAKE

SEQ ID NO: 2240 - protein, 10 aa, Homo sapiens
DSAVQNLQAK

SEQ ID NO: 2241 - protein, 10 aa, Homo sapiens
ESMELLDSAV

SEQ ID NO: 2242 - protein, 10 aa, Homo sapiens
SYGLTIKPKS

SEQ ID NO: 2243 - protein, 10 aa, Homo sapiens
ISILAHQCDF

SEQ ID NO: 2244 - protein, 10 aa, Homo sapiens
LKWPNPENFD

SEQ ID NO: 2245 - protein, 10 aa, Homo sapiens
AMRFSSFVPV

SEQ ID NO: 2246 - protein, 10 aa, Homo sapiens
PNLPYVLAFL

SEQ ID NO: 2247 - protein, 10 aa, Homo sapiens
TRYPDVQTRV

SEQ ID NO: 2248 - protein, 10 aa, Homo sapiens
ENVPATITDI

SEQ ID NO: 2249 - protein, 10 aa, Homo sapiens
LENVPATITD

SEQ ID NO: 2250 - protein, 10 aa, Homo sapiens
LSAEKKAAGD

SEQ ID NO: 2251 - protein, 10 aa, Homo sapiens
GAAPRDMMDA

SEQ ID NO: 2252 - protein, 10 aa, Homo sapiens
ESLRPGAAPR

SEQ ID NO: 2253 - protein, 10 aa, Homo sapiens
SNFILDKFLR

SEQ ID NO: 2254 - protein, 10 aa, Homo sapiens
YFPNPVRTVF

SEQ ID NO: 2255 - protein, 10 aa, Homo sapiens
DVMPWLQYFP

SEQ ID NO: 2256 - protein, 10 aa, Homo sapiens
GSLVDVMPWL

SEQ ID NO: 2257 - protein, 10 aa, Homo sapiens
VGAGSLVDVM

SEQ ID NO: 2258 - protein, 10 aa, Homo sapiens
VMSAVCFGCR

SEQ ID NO: 2259 - protein, 10 aa, Homo sapiens
SRQVLEGHVL

SEQ ID NO: 2260 - protein, 10 aa, Homo sapiens
RSRQVLEGHV

SEQ ID NO: 2261 - protein, 10 aa, Homo sapiens
RSMAFGHYSE

SEQ ID NO: 2262 - protein, 10 aa, Homo sapiens
RPAFASFRVV

SEQ ID NO: 2263 - protein, 10 aa, Homo sapiens
RYGDVFQIRL

SEQ ID NO: 2264 - protein, 10 aa, Homo sapiens
RRYGDVFQIR

SEQ ID NO: 2265 - protein, 10 aa, Homo sapiens
AAVGQAAHLS

SEQ ID NO: 2266 - protein, 10 aa, Homo sapiens
GPFAWPLIGN

SEQ ID NO: 2267 - protein, 10 aa, Homo sapiens
LLRQRRRQLR

SEQ ID NO: 2268 - protein, 10 aa, Homo sapiens
WPLNPLSIQQ

SEQ ID NO: 2269 - protein, 10 aa, Homo sapiens
TSLSPNDPWP

SEQ ID NO: 2270 - protein, 10 aa, Homo sapiens
AKMNFSYGLT

SEQ ID NO: 2271 - protein, 10 aa, Homo sapiens
EPAKMNFSYG

SEQ ID NO: 2272 - protein, 10 aa, Homo sapiens
LAHQCDFRAN

SEQ ID NO: 2273 - protein, 10 aa, Homo sapiens
ELSKMQLFLF

SEQ ID NO: 2274 - protein, 10 aa, Homo sapiens
RCIGEELSKM

SEQ ID NO: 2275 - protein, 10 aa, Homo sapiens
RVMIFSVGKR

SEQ ID NO: 2276 - protein, 10 aa, Homo sapiens
ARFLDKDGLI

SEQ ID NO: 2277 - protein, 10 aa, Homo sapiens
FDPARFLDKD

SEQ ID NO: 2278 - protein, 10 aa, Homo sapiens
ENFDPARFLD

SEQ ID NO: 2279 - protein, 10 aa, Homo sapiens
FLYEAMRFSS

SEQ ID NO: 2280 - protein, 10 aa, Homo sapiens
VLAFLYEAMR

SEQ ID NO: 2281 - protein, 10 aa, Homo sapiens
PCMGDQPNLP

SEQ ID NO: 2282 - protein, 10 aa, Homo sapiens
VQTRVQAELD

SEQ ID NO: 2283 - protein, 10 aa, Homo sapiens
TLSTALQWLL

SEQ ID NO: 2284 - protein, 10 aa, Homo sapiens
HGGGARLDLE

SEQ ID NO: 2285 - protein, 10 aa, Homo sapiens
AFILSAEKKA

SEQ ID NO: 2286 - protein, 10 aa, Homo sapiens
EQLNRNFSNF

SEQ ID NO: 2287 - protein, 10 aa, Homo sapiens
NPVRTVFREF

SEQ ID NO: 2288 - protein, 10 aa, Homo sapiens
WLQYFPNPVR

SEQ ID NO: 2289 - protein, 10 aa, Homo sapiens
MPWLQYFPNP

SEQ ID NO: 2290 - protein, 10 aa, Homo sapiens
GRTVGAGSLV

SEQ ID NO: 2291 - protein, 10 aa, Homo sapiens
SHNEEFGRTV

SEQ ID NO: 2292 - protein, 10 aa, Homo sapiens
GAFLDPRPLT

SEQ ID NO: 2293 - protein, 10 aa, Homo sapiens
HVLSEARELV

SEQ ID NO: 2294 - protein, 10 aa, Homo sapiens
FGHYSEHWKV

SEQ ID NO: 2295 - protein, 10 aa, Homo sapiens
SFRVVSGGRS

SEQ ID NO: 2296 - protein, 10 aa, Homo sapiens
LGSCPIVVLN

SEQ ID NO: 2297 - protein, 10 aa, Homo sapiens
RLARRYGDVF

SEQ ID NO: 2298 - protein, 10 aa, Homo sapiens
SFARLARRYG

SEQ ID NO: 2299 - protein, 10 aa, Homo sapiens
AAHLSFARLA

SEQ ID NO: 2300 - protein, 10 aa, Homo sapiens
QAAHLSFARL

SEQ ID NO: 2301 - protein, 10 aa, Homo sapiens
PLIGNAAAVG

SEQ ID NO: 2302 - protein, 10 aa, Homo sapiens
VLATVHVGQR

SEQ ID NO: 2303 - protein, 10 aa, Homo sapiens
TLLLLLSVLA

SEQ ID NO: 2304 - protein, 10 aa, Homo sapiens
PLSIQQTTLL

SEQ ID NO: 2305 - protein, 10 aa, Homo sapiens
NDPWPLNPLS

SEQ ID NO: 2306 - protein, 10 aa, Homo sapiens
ELLDSAVQNL

SEQ ID NO: 2307 - protein, 10 aa, Homo sapiens
VNVTLRESME

SEQ ID NO: 2308 - protein, 10 aa, Homo sapiens
KPKSFKVNVT

SEQ ID NO: 2309 - protein, 10 aa, Homo sapiens
YGLTIKPKSF

SEQ ID NO: 2310 - protein, 10 aa, Homo sapiens
ANPNEPAKMN

SEQ ID NO: 2311 - protein, 10 aa, Homo sapiens
AHQCDFRANP

SEQ ID NO: 2312 - protein, 10 aa, Homo sapiens
SILAHQCDFR

SEQ ID NO: 2313 - protein, 10 aa, Homo sapiens
FLFISILAHQ

SEQ ID NO: 2314 - protein, 10 aa, Homo sapiens
SKMQLFLFIS

SEQ ID NO: 2315 - protein, 10 aa, Homo sapiens
KRRCIGEELS

SEQ ID NO: 2316 - protein, 10 aa, Homo sapiens
VMIFSVGKRR

SEQ ID NO: 2317 - protein, 10 aa, Homo sapiens
SRVMIFSVGK

SEQ ID NO: 2318 - protein, 10 aa, Homo sapiens
KDGLINKDLT

SEQ ID NO: 2319 - protein, 10 aa, Homo sapiens
LDKDGLINKD

SEQ ID NO: 2320 - protein, 10 aa, Homo sapiens
SVNHDPLKWP

SEQ ID NO: 2321 - protein, 10 aa, Homo sapiens
QWSVNHDPLK

SEQ ID NO: 2322 - protein, 10 aa, Homo sapiens
VNQWSVNHDP

SEQ ID NO: 2323 - protein, 10 aa, Homo sapiens
FVNQWSVNHD

SEQ ID NO: 2324 - protein, 10 aa, Homo sapiens
VVFVNQWSVN

SEQ ID NO: 2325 - protein, 10 aa, Homo sapiens
IPKDTVVFVN

SEQ ID NO: 2326 - protein, 10 aa, Homo sapiens
VLGYHIPKDT

SEQ ID NO: 2327 - protein, 10 aa, Homo sapiens
ANTSVLGYHI

SEQ ID NO: 2328 - protein, 10 aa, Homo sapiens
MRFSSFVPVT

SEQ ID NO: 2329 - protein, 10 aa, Homo sapiens
YEAMRFSSFV

SEQ ID NO: 2330 - protein, 10 aa, Homo sapiens
YVLAFLYEAM

SEQ ID NO: 2331 - protein, 10 aa, Homo sapiens
DQPNLPYVLA

SEQ ID NO: 2332 - protein, 10 aa, Homo sapiens
VGRDRLPCMG

SEQ ID NO: 2333 - protein, 10 aa, Homo sapiens
DQVVGRDRLP

SEQ ID NO: 2334 - protein, 10 aa, Homo sapiens
AELDQVVGRD

SEQ ID NO: 2335 - protein, 10 aa, Homo sapiens
VQAELDQVVG

SEQ ID NO: 2336 - protein, 10 aa, Homo sapiens
LLFTRYPDVQ

SEQ ID NO: 2337 - protein, 10 aa, Homo sapiens
LLLLFTRYPD

SEQ ID NO: 2338 - protein, 10 aa, Homo sapiens
IFGASQDTLS

SEQ ID NO: 2339 - protein, 10 aa, Homo sapiens
ARLDLENVPA

SEQ ID NO: 2340 - protein, 10 aa, Homo sapiens
AAGDSHGGGA

SEQ ID NO: 2341 - protein, 10 aa, Homo sapiens
AEKKAAGDSH

SEQ ID NO: 2342 - protein, 10 aa, Homo sapiens
DAFILSAEKK

SEQ ID NO: 2343 - protein, 10 aa, Homo sapiens
RPGAAPRDMM

SEQ ID NO: 2344 - protein, 10 aa, Homo sapiens
KFLRHCESLR

SEQ ID NO: 2345 - protein, 10 aa, Homo sapiens
NFSNFILDKF

SEQ ID NO: 2346 - protein, 10 aa, Homo sapiens
FEQLNRNFSN

SEQ ID NO: 2347 - protein, 10 aa, Homo sapiens
TVFREFEQLN

SEQ ID NO: 2348 - protein, 10 aa, Homo sapiens
AGSLVDVMPW

SEQ ID NO: 2349 - protein, 10 aa, Homo sapiens
EEFGRTVGAG

SEQ ID NO: 2350 - protein, 10 aa, Homo sapiens
VCFGCRYSHD

SEQ ID NO: 2351 - protein, 10 aa, Homo sapiens
AVCFGCRYSH

SEQ ID NO: 2352 - protein, 10 aa, Homo sapiens
SAVCFGCRYS

SEQ ID NO: 2353 - protein, 10 aa, Homo sapiens
ANVMSAVCFG

SEQ ID NO: 2354 - protein, 10 aa, Homo sapiens
AVANVMSAVC

SEQ ID NO: 2355 - protein, 10 aa, Homo sapiens
VVAVANVMSA

SEQ ID NO: 2356 - protein, 10 aa, Homo sapiens
TVVAVANVMS

SEQ ID NO: 2357 - protein, 10 aa, Homo sapiens
PLTVVAVANV

SEQ ID NO: 2358 - protein, 10 aa, Homo sapiens
PRPLTVVAVA

SEQ ID NO: 2359 - protein, 10 aa, Homo sapiens
RGSADGAFLD

SEQ ID NO: 2360 - protein, 10 aa, Homo sapiens
VRGSADGAFL

SEQ ID NO: 2361 - protein, 10 aa, Homo sapiens
ALLVRGSADG

SEQ ID NO: 2362 - protein, 10 aa, Homo sapiens
VALLVRGSAD

SEQ ID NO: 2363 - protein, 10 aa, Homo sapiens
ELVALLVRGS

SEQ ID NO: 2364 - protein, 10 aa, Homo sapiens
RQVLEGHVLS

SEQ ID NO: 2365 - protein, 10 aa, Homo sapiens
RQPRSRQVLE

SEQ ID NO: 2366 - protein, 10 aa, Homo sapiens
FFTRQPRSRQ

SEQ ID NO: 2367 - protein, 10 aa, Homo sapiens
AHSMMRNFFT

SEQ ID NO: 2368 - protein, 10 aa, Homo sapiens
AAHSMMRNFF

SEQ ID NO: 2369 - protein, 10 aa, Homo sapiens
VQRRAAHSMM

SEQ ID NO: 2370 - protein, 10 aa, Homo sapiens
SEHWKVQRRA

SEQ ID NO: 2371 - protein, 10 aa, Homo sapiens
SMAFGHYSEH

SEQ ID NO: 2372 - protein, 10 aa, Homo sapiens
SGGRSMAFGH

SEQ ID NO: 2373 - protein, 10 aa, Homo sapiens
VVSGGRSMAF

SEQ ID NO: 2374 - protein, 10 aa, Homo sapiens
RVVSGGRSMA

SEQ ID NO: 2375 - protein, 10 aa, Homo sapiens
FRVVSGGRSM

SEQ ID NO: 2376 - protein, 10 aa, Homo sapiens
FASFRVVSGG

SEQ ID NO: 2377 - protein, 10 aa, Homo sapiens
AFASFRVVSG

SEQ ID NO: 2378 - protein, 10 aa, Homo sapiens
PAFASFRVVS

SEQ ID NO: 2379 - protein, 10 aa, Homo sapiens
SAFADRPAFA

SEQ ID NO: 2380 - protein, 10 aa, Homo sapiens
ALVQQGSAFA

SEQ ID NO: 2381 - protein, 10 aa, Homo sapiens
AIHQALVQQG

SEQ ID NO: 2382 - protein, 10 aa, Homo sapiens
GERAIHQALV

SEQ ID NO: 2383 - protein, 10 aa, Homo sapiens
VVLNGERAIH

SEQ ID NO: 2384 - protein, 10 aa, Homo sapiens
SCPIVVLNGE

SEQ ID NO: 2385 - protein, 10 aa, Homo sapiens
RLGSCPIVVL

SEQ ID NO: 2386 - protein, 10 aa, Homo sapiens
VFQIRLGSCP

SEQ ID NO: 2387 - protein, 10 aa, Homo sapiens
ARRYGDVFQI

SEQ ID NO: 2388 - protein, 10 aa, Homo sapiens
FARLARRYGD

SEQ ID NO: 2389 - protein, 10 aa, Homo sapiens
AWPLIGNAAA

SEQ ID NO: 2390 - protein, 10 aa, Homo sapiens
APPGPFAWPL

SEQ ID NO: 2391 - protein, 10 aa, Homo sapiens
RLLRQRRRQL

SEQ ID NO: 2392 - protein, 10 aa, Homo sapiens
VGQRLLRQRR

SEQ ID NO: 2393 - protein, 10 aa, Homo sapiens
SVLATVHVGQ

SEQ ID NO: 2394 - protein, 10 aa, Homo sapiens
LLLSVLATVH

SEQ ID NO: 2395 - protein, 10 aa, Homo sapiens
VQNLQAKETC

SEQ ID NO: 2396 - protein, 10 aa, Homo sapiens
AVQNLQAKET

SEQ ID NO: 2397 - protein, 10 aa, Homo sapiens
KVNVTLRESM

SEQ ID NO: 2398 - protein, 10 aa, Homo sapiens
FKVNVTLRES

SEQ ID NO: 2399 - protein, 10 aa, Homo sapiens
PKSFKVNVTL

SEQ ID NO: 2400 - protein, 10 aa, Homo sapiens
GLTIKPKSFK

SEQ ID NO: 2401 - protein, 10 aa, Homo sapiens
FRANPNEPAK

SEQ ID NO: 2402 - protein, 10 aa, Homo sapiens
DFRANPNEPA

SEQ ID NO: 2403 - protein, 10 aa, Homo sapiens
ILAHQCDFRA

SEQ ID NO: 2404 - protein, 10 aa, Homo sapiens
FISILAHQCD

SEQ ID NO: 2405 - protein, 10 aa, Homo sapiens
CIGEELSKMQ

SEQ ID NO: 2406 - protein, 10 aa, Homo sapiens
GKRRCIGEEL

SEQ ID NO: 2407 - protein, 10 aa, Homo sapiens
VGKRRCIGEE

SEQ ID NO: 2408 - protein, 10 aa, Homo sapiens
IFSVGKRRCI

SEQ ID NO: 2409 - protein, 10 aa, Homo sapiens
KDLTSRVMIF

SEQ ID NO: 2410 - protein, 10 aa, Homo sapiens
INKDLTSRVM

SEQ ID NO: 2411 - protein, 10 aa, Homo sapiens
GLINKDLTSR

SEQ ID NO: 2412 - protein, 10 aa, Homo sapiens
KWPNPENFDP

SEQ ID NO: 2413 - protein, 10 aa, Homo sapiens
PLKWPNPENF

SEQ ID NO: 2414 - protein, 10 aa, Homo sapiens
DPLKWPNPEN

SEQ ID NO: 2415 - protein, 10 aa, Homo sapiens
VNHDPLKWPN

SEQ ID NO: 2416 - protein, 10 aa, Homo sapiens
VFVNQWSVNH

SEQ ID NO: 2417 - protein, 10 aa, Homo sapiens
KDTVVFVNQW

SEQ ID NO: 2418 - protein, 10 aa, Homo sapiens
HIPKDTVVFV

SEQ ID NO: 2419 - protein, 10 aa, Homo sapiens
GYHIPKDTVV

SEQ ID NO: 2420 - protein, 10 aa, Homo sapiens
HATTANTSVL

SEQ ID NO: 2421 - protein, 10 aa, Homo sapiens
PHATTANTSV

SEQ ID NO: 2422 - protein, 10 aa, Homo sapiens
VPVTIPHATT

SEQ ID NO: 2423 - protein, 10 aa, Homo sapiens
FVPVTIPHAT

SEQ ID NO: 2424 - protein, 10 aa, Homo sapiens
EAMRFSSFVP

SEQ ID NO: 2425 - protein, 10 aa, Homo sapiens
AFLYEAMRFS

SEQ ID NO: 2426 - protein, 10 aa, Homo sapiens
RLPCMGDQPN

SEQ ID NO: 2427 - protein, 10 aa, Homo sapiens
VVGRDRLPCM

SEQ ID NO: 2428 - protein, 10 aa, Homo sapiens
LDQVVGRDRL

SEQ ID NO: 2429 - protein, 10 aa, Homo sapiens
RVQAELDQVV

SEQ ID NO: 2430 - protein, 10 aa, Homo sapiens
PDVQTRVQAE

SEQ ID NO: 2431 - protein, 10 aa, Homo sapiens
RYPDVQTRVQ

SEQ ID NO: 2432 - protein, 10 aa, Homo sapiens
LLLFTRYPDV

SEQ ID NO: 2433 - protein, 10 aa, Homo sapiens
WLLLLFTRYP

SEQ ID NO: 2434 - protein, 10 aa, Homo sapiens
DIFGASQDTL

SEQ ID NO: 2435 - protein, 10 aa, Homo sapiens
TITDIFGASQ

SEQ ID NO: 2436 - protein, 10 aa, Homo sapiens
GARLDLENVP

SEQ ID NO: 2437 - protein, 10 aa, Homo sapiens
GDSHGGGARL

SEQ ID NO: 2438 - protein, 10 aa, Homo sapiens
KAAGDSHGGG

SEQ ID NO: 2439 - protein, 10 aa, Homo sapiens
ILSAEKKAAG

SEQ ID NO: 2440 - protein, 10 aa, Homo sapiens
FILSAEKKAA

SEQ ID NO: 2441 - protein, 10 aa, Homo sapiens
APRDMMDAFI

SEQ ID NO: 2442 - protein, 10 aa, Homo sapiens
AAPRDMMDAF

SEQ ID NO: 2443 - protein, 10 aa, Homo sapiens
PGAAPRDMMD

SEQ ID NO: 2444 - protein, 10 aa, Homo sapiens
LRPGAAPRDM

SEQ ID NO: 2445 - protein, 10 aa, Homo sapiens
CESLRPGAAP

SEQ ID NO: 2446 - protein, 10 aa, Homo sapiens
RHCESLRPGA

SEQ ID NO: 2447 - protein, 10 aa, Homo sapiens
FILDKFLRHC

SEQ ID NO: 2448 - protein, 10 aa, Homo sapiens
LNRNFSNFIL

SEQ ID NO: 2449 - protein, 10 aa, Homo sapiens
QLNRNFSNFI

SEQ ID NO: 2450 - protein, 10 aa, Homo sapiens
REFEQLNRNF

SEQ ID NO: 2451 - protein, 10 aa, Homo sapiens
VRTVFREFEQ

SEQ ID NO: 2452 - protein, 10 aa, Homo sapiens
PVRTVFREFE

SEQ ID NO: 2453 - protein, 10 aa, Homo sapiens
PNPVRTVFRE

SEQ ID NO: 2454 - protein, 10 aa, Homo sapiens
VMPWLQYFPN

SEQ ID NO: 2455 - protein, 10 aa, Homo sapiens
VDVMPWLQYF

SEQ ID NO: 2456 - protein, 10 aa, Homo sapiens
GAGSLVDVMP

SEQ ID NO: 2457 - protein, 10 aa, Homo sapiens
FGRTVGAGSL

SEQ ID NO: 2458 - protein, 10 aa, Homo sapiens
EFGRTVGAGS

SEQ ID NO: 2459 - protein, 10 aa, Homo sapiens
LLSHNEEFGR

SEQ ID NO: 2460 - protein, 10 aa, Homo sapiens
ELLSHNEEFG

SEQ ID NO: 2461 - protein, 10 aa, Homo sapiens
RELLSHNEEF

SEQ ID NO: 2462 - protein, 10 aa, Homo sapiens
FGCRYSHDDP

SEQ ID NO: 2463 - protein, 10 aa, Homo sapiens
VANVMSAVCF

SEQ ID NO: 2464 - protein, 10 aa, Homo sapiens
VAVANVMSAV

SEQ ID NO: 2465 - protein, 10 aa, Homo sapiens
LDPRPLTVVA

SEQ ID NO: 2466 - protein, 10 aa, Homo sapiens
ADGAFLDPRP

SEQ ID NO: 2467 - protein, 10 aa, Homo sapiens
LVRGSADGAF

SEQ ID NO: 2468 - protein, 10 aa, Homo sapiens
LLVRGSADGA

SEQ ID NO: 2469 - protein, 10 aa, Homo sapiens
LVALLVRGSA

SEQ ID NO: 2470 - protein, 10 aa, Homo sapiens
MRNFFTRQPR

SEQ ID NO: 2471 - protein, 10 aa, Homo sapiens
QRRAAHSMMR

SEQ ID NO: 2472 - protein, 10 aa, Homo sapiens
HWKVQRRAAH

SEQ ID NO: 2473 - protein, 10 aa, Homo sapiens
EHWKVQRRAA

SEQ ID NO: 2474 - protein, 10 aa, Homo sapiens
GHYSEHWKVQ

SEQ ID NO: 2475 - protein, 10 aa, Homo sapiens
AFGHYSEHWK

SEQ ID NO: 2476 - protein, 10 aa, Homo sapiens
MAFGHYSEHW

SEQ ID NO: 2477 - protein, 10 aa, Homo sapiens
GRSMAFGHYS

SEQ ID NO: 2478 - protein, 10 aa, Homo sapiens
AFADRPAFAS

SEQ ID NO: 2479 - protein, 10 aa, Homo sapiens
QALVQQGSAF

SEQ ID NO: 2480 - protein, 10 aa, Homo sapiens
PIVVLNGERA

SEQ ID NO: 2481 - protein, 10 aa, Homo sapiens
CPIVVLNGER

SEQ ID NO: 2482 - protein, 10 aa, Homo sapiens
FQIRLGSCPI

SEQ ID NO: 2483 - protein, 10 aa, Homo sapiens
ARLARRYGDV

SEQ ID NO: 2484 - protein, 10 aa, Homo sapiens
HLSFARLARR

SEQ ID NO: 2485 - protein, 10 aa, Homo sapiens
VGQAAHLSFA

SEQ ID NO: 2486 - protein, 10 aa, Homo sapiens
AAAVGQAAHL

SEQ ID NO: 2487 - protein, 10 aa, Homo sapiens
GNAAAVGQAA

SEQ ID NO: 2488 - protein, 10 aa, Homo sapiens
IGNAAAVGQA

SEQ ID NO: 2489 - protein, 10 aa, Homo sapiens
LRSAPPGPFA

SEQ ID NO: 2490 - protein, 10 aa, Homo sapiens
QLRSAPPGPF

SEQ ID NO: 2491 - protein, 10 aa, Homo sapiens
QRRRQLRSAP

SEQ ID NO: 2492 - protein, 10 aa, Homo sapiens
QRLLRQRRRQ

SEQ ID NO: 2493 - protein, 10 aa, Homo sapiens
LATVHVGQRL

SEQ ID NO: 2494 - protein, 10 aa, Homo sapiens
LLSVLATVHV

SEQ ID NO: 2495 - protein, 10 aa, Homo sapiens
LLLLSVLATV

SEQ ID NO: 2496 - protein, 9 aa, Homo sapiens
DVMPWLQYF

SEQ ID NO: 2497 - protein, 9 aa, Homo sapiens
DLTSRVMIF

SEQ ID NO: 2498 - protein, 9 aa, Homo sapiens
CIGEELSKM

SEQ ID NO: 2499 - protein, 9 aa, Homo sapiens
ELLSHNEEF

SEQ ID NO: 2500 - protein, 9 aa, Homo sapiens
EFEQLNRNF

SEQ ID NO: 2501 - protein, 9 aa, Homo sapiens
TVFREFEQL

SEQ ID NO: 2502 - protein, 9 aa, Homo sapiens
PVRTVFREF

SEQ ID NO: 2503 - protein, 9 aa, Homo sapiens
LLDSAVQNL

SEQ ID NO: 2504 - protein, 9 aa, Homo sapiens
WLLLLFTRY

SEQ ID NO: 2505 - protein, 9 aa, Homo sapiens
QLNRNFSNF

SEQ ID NO: 2506 - protein, 9 aa, Homo sapiens
TLRESMELL

SEQ ID NO: 2507 - protein, 9 aa, Homo sapiens
QLFLFISIL

SEQ ID NO: 2508 - protein, 9 aa, Homo sapiens
ELSKMQLFL

SEQ ID NO: 2509 - protein, 9 aa, Homo sapiens
EELSKMQLF

SEQ ID NO: 2510 - protein, 9 aa, Homo sapiens
HIPKDTVVF

SEQ ID NO: 2511 - protein, 9 aa, Homo sapiens
VLAFLYEAM

SEQ ID NO: 2512 - protein, 9 aa, Homo sapiens
ALQWLLLLF

SEQ ID NO: 2513 - protein, 9 aa, Homo sapiens
NLPYVLAFL

SEQ ID NO: 2514 - protein, 9 aa, Homo sapiens
DVQTRVQAE

SEQ ID NO: 2515 - protein, 9 aa, Homo sapiens
SLVDVMPWL

SEQ ID NO: 2516 - protein, 9 aa, Homo sapiens
EARELVALL

SEQ ID NO: 2517 - protein, 9 aa, Homo sapiens
ALVQQGSAF

SEQ ID NO: 2518 - protein, 9 aa, Homo sapiens
TLLLLLSVL

SEQ ID NO: 2519 - protein, 9 aa, Homo sapiens
DTVVFVNQW

SEQ ID NO: 2520 - protein, 9 aa, Homo sapiens
ELDQVVGRD

SEQ ID NO: 2521 - protein, 9 aa, Homo sapiens
TLSTALQWL

SEQ ID NO: 2522 - protein, 9 aa, Homo sapiens
DIFGASQDT

SEQ ID NO: 2523 - protein, 9 aa, Homo sapiens
EFRELLSHN

SEQ ID NO: 2524 - protein, 9 aa, Homo sapiens
ELVALLVRG

SEQ ID NO: 2525 - protein, 9 aa, Homo sapiens
VTLRESMEL

SEQ ID NO: 2526 - protein, 9 aa, Homo sapiens
GLTIKPKSF

SEQ ID NO: 2527 - protein, 9 aa, Homo sapiens
SILAHQCDF

SEQ ID NO: 2528 - protein, 9 aa, Homo sapiens
STALQWLLL

SEQ ID NO: 2529 - protein, 9 aa, Homo sapiens
HVLSEAREL

SEQ ID NO: 2530 - protein, 9 aa, Homo sapiens
RVVSGGRSM

SEQ ID NO: 2531 - protein, 9 aa, Homo sapiens
DVFQIRLGS

SEQ ID NO: 2532 - protein, 9 aa, Homo sapiens
ATVHVGQRL

SEQ ID NO: 2533 - protein, 9 aa, Homo sapiens
EPAKMNFSY

SEQ ID NO: 2534 - protein, 9 aa, Homo sapiens
ATTANTSVL

SEQ ID NO: 2535 - protein, 9 aa, Homo sapiens
SFARLARRY

SEQ ID NO: 2536 - protein, 9 aa, Homo sapiens
SIQQTTLLL

SEQ ID NO: 2537 - protein, 9 aa, Homo sapiens
ELLDSAVQN

SEQ ID NO: 2538 - protein, 9 aa, Homo sapiens
AFLYEAMRF

SEQ ID NO: 2539 - protein, 9 aa, Homo sapiens
DTLSTALQW

SEQ ID NO: 2540 - protein, 9 aa, Homo sapiens
DSHGGGARL

SEQ ID NO: 2541 - protein, 9 aa, Homo sapiens
TVVAVANVM

SEQ ID NO: 2542 - protein, 9 aa, Homo sapiens
ADRPAFASF

SEQ ID NO: 2543 - protein, 9 aa, Homo sapiens
LLRQRRRQL

SEQ ID NO: 2544 - protein, 9 aa, Homo sapiens
TVHVGQRLL

SEQ ID NO: 2545 - protein, 9 aa, Homo sapiens
ENFDPARFL

SEQ ID NO: 2546 - protein, 9 aa, Homo sapiens
FVPVTIPHA

SEQ ID NO: 2547 - protein, 9 aa, Homo sapiens
YEAMRFSSF

SEQ ID NO: 2548 - protein, 9 aa, Homo sapiens
PNLPYVLAF

SEQ ID NO: 2549 - protein, 9 aa, Homo sapiens
ATITDIFGA

SEQ ID NO: 2550 - protein, 9 aa, Homo sapiens
FILDKFLRH

SEQ ID NO: 2551 - protein, 9 aa, Homo sapiens
EFGRTVGAG

SEQ ID NO: 2552 - protein, 9 aa, Homo sapiens
DDPEFRELL

SEQ ID NO: 2553 - protein, 9 aa, Homo sapiens
AVANVMSAV

SEQ ID NO: 2554 - protein, 9 aa, Homo sapiens
LVALLVRGS

SEQ ID NO: 2555 - protein, 9 aa, Homo sapiens
AIHQALVQQ

SEQ ID NO: 2556 - protein, 9 aa, Homo sapiens
PLSIQQTTL

SEQ ID NO: 2557 - protein, 9 aa, Homo sapiens
FLFISILAH

SEQ ID NO: 2558 - protein, 9 aa, Homo sapiens
LSKMQLFLF

SEQ ID NO: 2559 - protein, 9 aa, Homo sapiens
LINKDLTSR

SEQ ID NO: 2560 - protein, 9 aa, Homo sapiens
TANTSVLGY

SEQ ID NO: 2561 - protein, 9 aa, Homo sapiens
DQPNLPYVL

SEQ ID NO: 2562 - protein, 9 aa, Homo sapiens
TITDIFGAS

SEQ ID NO: 2563 - protein, 9 aa, Homo sapiens
APRDMMDAF

SEQ ID NO: 2564 - protein, 9 aa, Homo sapiens
HDDPEFREL

SEQ ID NO: 2565 - protein, 9 aa, Homo sapiens
LTVVAVANV

SEQ ID NO: 2566 - protein, 9 aa, Homo sapiens
AAHSMMRNF

SEQ ID NO: 2567 - protein, 9 aa, Homo sapiens
HVGQRLLRQ

SEQ ID NO: 2568 - protein, 9 aa, Homo sapiens
TTLLLLLSV

SEQ ID NO: 2569 - protein, 9 aa, Homo sapiens
KVNVTLRES

SEQ ID NO: 2570 - protein, 9 aa, Homo sapiens
TIKPKSFKV

SEQ ID NO: 2571 - protein, 9 aa, Homo sapiens
LFISILAHQ

SEQ ID NO: 2572 - protein, 9 aa, Homo sapiens
DKDGLINKD

SEQ ID NO: 2573 - protein, 9 aa, Homo sapiens
YVLAFLYEA

SEQ ID NO: 2574 - protein, 9 aa, Homo sapiens
DQVVGRDRL

SEQ ID NO: 2575 - protein, 9 aa, Homo sapiens
RVQAELDQV

SEQ ID NO: 2576 - protein, 9 aa, Homo sapiens
LLFTRYPDV

SEQ ID NO: 2577 - protein, 9 aa, Homo sapiens
IFGASQDTL

SEQ ID NO: 2578 - protein, 9 aa, Homo sapiens
NVPATITDI

SEQ ID NO: 2579 - protein, 9 aa, Homo sapiens
DLENVPATI

SEQ ID NO: 2580 - protein, 9 aa, Homo sapiens
KFLRHCESL

SEQ ID NO: 2581 - protein, 9 aa, Homo sapiens
ILDKFLRHC

SEQ ID NO: 2582 - protein, 9 aa, Homo sapiens
FSNFILDKF

SEQ ID NO: 2583 - protein, 9 aa, Homo sapiens
NVMSAVCFG

SEQ ID NO: 2584 - protein, 9 aa, Homo sapiens
SEARELVAL

SEQ ID NO: 2585 - protein, 9 aa, Homo sapiens
VLEGHVLSE

SEQ ID NO: 2586 - protein, 9 aa, Homo sapiens
GRSMAFGHY

SEQ ID NO: 2587 - protein, 9 aa, Homo sapiens
AAHLSFARL

SEQ ID NO: 2588 - protein, 9 aa, Homo sapiens
QTTLLLLLS

SEQ ID NO: 2589 - protein, 9 aa, Homo sapiens
ESMELLDSA

SEQ ID NO: 2590 - protein, 9 aa, Homo sapiens
LTIKPKSFK

SEQ ID NO: 2591 - protein, 9 aa, Homo sapiens
PNEPAKMNF

SEQ ID NO: 2592 - protein, 9 aa, Homo sapiens
MIFSVGKRR

SEQ ID NO: 2593 - protein, 9 aa, Homo sapiens
LTSRVMIFS

SEQ ID NO: 2594 - protein, 9 aa, Homo sapiens
VLGYHIPKD

SEQ ID NO: 2595 - protein, 9 aa, Homo sapiens
VTIPHATTA

SEQ ID NO: 2596 - protein, 9 aa, Homo sapiens
FLYEAMRFS

SEQ ID NO: 2597 - protein, 9 aa, Homo sapiens
VGRDRLPCM

SEQ ID NO: 2598 - protein, 9 aa, Homo sapiens
GAGSLVDVM

SEQ ID NO: 2599 - protein, 9 aa, Homo sapiens
LVRGSADGA

SEQ ID NO: 2600 - protein, 9 aa, Homo sapiens
VSGGRSMAF

SEQ ID NO: 2601 - protein, 9 aa, Homo sapiens
VVSGGRSMA

SEQ ID NO: 2602 - protein, 9 aa, Homo sapiens
SAFADRPAF

SEQ ID NO: 2603 - protein, 9 aa, Homo sapiens
PLIGNAAAV

SEQ ID NO: 2604 - protein, 9 aa, Homo sapiens
SVLATVHVG

SEQ ID NO: 2605 - protein, 9 aa, Homo sapiens
LLLSVLATV

SEQ ID NO: 2606 - protein, 9 aa, Homo sapiens
LLLLSVLAT

SEQ ID NO: 2607 - protein, 9 aa, Homo sapiens
AVQNLQAKE

SEQ ID NO: 2608 - protein, 9 aa, Homo sapiens
DFRANPNEP

SEQ ID NO: 2609 - protein, 9 aa, Homo sapiens
LKWPNPENF

SEQ ID NO: 2610 - protein, 9 aa, Homo sapiens
FVNQWSVNH

SEQ ID NO: 2611 - protein, 9 aa, Homo sapiens
VVFVNQWSV

SEQ ID NO: 2612 - protein, 9 aa, Homo sapiens
TALQWLLLL

SEQ ID NO: 2613 - protein, 9 aa, Homo sapiens
ITDIFGASQ

SEQ ID NO: 2614 - protein, 9 aa, Homo sapiens
RTVGAGSLV

SEQ ID NO: 2615 - protein, 9 aa, Homo sapiens
VVAVANVMS

SEQ ID NO: 2616 - protein, 9 aa, Homo sapiens
QVLEGHVLS

SEQ ID NO: 2617 - protein, 9 aa, Homo sapiens
FTRQPRSRQ

SEQ ID NO: 2618 - protein, 9 aa, Homo sapiens
LGSCPIVVL

SEQ ID NO: 2619 - protein, 9 aa, Homo sapiens
RLARRYGDV

SEQ ID NO: 2620 - protein, 9 aa, Homo sapiens
AAVGQAAHL

SEQ ID NO: 2621 - protein, 9 aa, Homo sapiens
QQTTLLLLL

SEQ ID NO: 2622 - protein, 9 aa, Homo sapiens
NDPWPLNPL

SEQ ID NO: 2623 - protein, 9 aa, Homo sapiens
NVTLRESME

SEQ ID NO: 2624 - protein, 9 aa, Homo sapiens
KSFKVNVTL

SEQ ID NO: 2625 - protein, 9 aa, Homo sapiens
FISILAHQC

SEQ ID NO: 2626 - protein, 9 aa, Homo sapiens
RVMIFSVGK

SEQ ID NO: 2627 - protein, 9 aa, Homo sapiens
DPARFLDKD

SEQ ID NO: 2628 - protein, 9 aa, Homo sapiens
PENFDPARF

SEQ ID NO: 2629 - protein, 9 aa, Homo sapiens
SVLGYHIPK

SEQ ID NO: 2630 - protein, 9 aa, Homo sapiens
NTSVLGYHI

SEQ ID NO: 2631 - protein, 9 aa, Homo sapiens
TTANTSVLG

SEQ ID NO: 2632 - protein, 9 aa, Homo sapiens
TIPHATTAN

SEQ ID NO: 2633 - protein, 9 aa, Homo sapiens
RFSSFVPVT

SEQ ID NO: 2634 - protein, 9 aa, Homo sapiens
MGDQPNLPY

SEQ ID NO: 2635 - protein, 9 aa, Homo sapiens
PCMGDQPNL

SEQ ID NO: 2636 - protein, 9 aa, Homo sapiens
DRLPCMGDQ

SEQ ID NO: 2637 - protein, 9 aa, Homo sapiens
QVVGRDRLP

SEQ ID NO: 2638 - protein, 9 aa, Homo sapiens
FTRYPDVQT

SEQ ID NO: 2639 - protein, 9 aa, Homo sapiens
FILSAEKKA

SEQ ID NO: 2640 - protein, 9 aa, Homo sapiens
FPNPVRTVF

SEQ ID NO: 2641 - protein, 9 aa, Homo sapiens
EEFGRTVGA

SEQ ID NO: 2642 - protein, 9 aa, Homo sapiens
RYSHDDPEF

SEQ ID NO: 2643 - protein, 9 aa, Homo sapiens
CFGCRYSHD

SEQ ID NO: 2644 - protein, 9 aa, Homo sapiens
ANVMSAVCF

SEQ ID NO: 2645 - protein, 9 aa, Homo sapiens
VRGSADGAF

SEQ ID NO: 2646 - protein, 9 aa, Homo sapiens
KVQRRAAHS

SEQ ID NO: 2647 - protein, 9 aa, Homo sapiens
LVQQGSAFA

SEQ ID NO: 2648 - protein, 9 aa, Homo sapiens
PIVVLNGER

SEQ ID NO: 2649 - protein, 9 aa, Homo sapiens
PFAWPLIGN

SEQ ID NO: 2650 - protein, 9 aa, Homo sapiens
IQQTTLLLL

SEQ ID NO: 2651 - protein, 9 aa, Homo sapiens
LSIQQTTLL

SEQ ID NO: 2652 - protein, 9 aa, Homo sapiens
PLNPLSIQQ

SEQ ID NO: 2653 - protein, 9 aa, Homo sapiens
SFKVNVTLR

SEQ ID NO: 2654 - protein, 9 aa, Homo sapiens
ANPNEPAKM

SEQ ID NO: 2655 - protein, 9 aa, Homo sapiens
GEELSKMQL

SEQ ID NO: 2656 - protein, 9 aa, Homo sapiens
SVGKRRCIG

SEQ ID NO: 2657 - protein, 9 aa, Homo sapiens
GLINKDLTS

SEQ ID NO: 2658 - protein, 9 aa, Homo sapiens
ARFLDKDGL

SEQ ID NO: 2659 - protein, 9 aa, Homo sapiens
PLKWPNPEN

SEQ ID NO: 2660 - protein, 9 aa, Homo sapiens
SVNHDPLKW

SEQ ID NO: 2661 - protein, 9 aa, Homo sapiens
TVVFVNQWS

SEQ ID NO: 2662 - protein, 9 aa, Homo sapiens
PVTIPHATT

SEQ ID NO: 2663 - protein, 9 aa, Homo sapiens
LPYVLAFLY

SEQ ID NO: 2664 - protein, 9 aa, Homo sapiens
QTRVQAELD

SEQ ID NO: 2665 - protein, 9 aa, Homo sapiens
SQDTLSTAL

SEQ ID NO: 2666 - protein, 9 aa, Homo sapiens
VPATITDIF

SEQ ID NO: 2667 - protein, 9 aa, Homo sapiens
DAFILSAEK

SEQ ID NO: 2668 - protein, 9 aa, Homo sapiens
DMMDAFILS

SEQ ID NO: 2669 - protein, 9 aa, Homo sapiens
SLRPGAAPR

SEQ ID NO: 2670 - protein, 9 aa, Homo sapiens
SNFILDKFL

SEQ ID NO: 2671 - protein, 9 aa, Homo sapiens
RTVFREFEQ

SEQ ID NO: 2672 - protein, 9 aa, Homo sapiens
YFPNPVRTV

SEQ ID NO: 2673 - protein, 9 aa, Homo sapiens
VDVMPWLQY

SEQ ID NO: 2674 - protein, 9 aa, Homo sapiens
LVDVMPWLQ

SEQ ID NO: 2675 - protein, 9 aa, Homo sapiens
SAVCFGCRY

SEQ ID NO: 2676 - protein, 9 aa, Homo sapiens
FLDPRPLTV

SEQ ID NO: 2677 - protein, 9 aa, Homo sapiens
RQPRSRQVL

SEQ ID NO: 2678 - protein, 9 aa, Homo sapiens
VLNGERAIH

SEQ ID NO: 2679 - protein, 9 aa, Homo sapiens
VVLNGERAI

SEQ ID NO: 2680 - protein, 9 aa, Homo sapiens
IVVLNGERA

SEQ ID NO: 2681 - protein, 9 aa, Homo sapiens
VFQIRLGSC

SEQ ID NO: 2682 - protein, 9 aa, Homo sapiens
VGQAAHLSF

SEQ ID NO: 2683 - protein, 9 aa, Homo sapiens
AVGQAAHLS

SEQ ID NO: 2684 - protein, 9 aa, Homo sapiens
LIGNAAAVG

SEQ ID NO: 2685 - protein, 9 aa, Homo sapiens
QLRSAPPGP

SEQ ID NO: 2686 - protein, 9 aa, Homo sapiens
VLATVHVGQ

SEQ ID NO: 2687 - protein, 9 aa, Homo sapiens
SLSPNDPWP

SEQ ID NO: 2688 - protein, 9 aa, Homo sapiens
GTSLSPNDP

SEQ ID NO: 2689 - protein, 9 aa, Homo sapiens
VNVTLRESM

SEQ ID NO: 2690 - protein, 9 aa, Homo sapiens
NFSYGLTIK

SEQ ID NO: 2691 - protein, 9 aa, Homo sapiens
ILAHQCDFR

SEQ ID NO: 2692 - protein, 9 aa, Homo sapiens
FLDKDGLIN

SEQ ID NO: 2693 - protein, 9 aa, Homo sapiens
RLPCMGDQP

SEQ ID NO: 2694 - protein, 9 aa, Homo sapiens
VVGRDRLPC

SEQ ID NO: 2695 - protein, 9 aa, Homo sapiens
VQTRVQAEL

SEQ ID NO: 2696 - protein, 9 aa, Homo sapiens
RLDLENVPA

SEQ ID NO: 2697 - protein, 9 aa, Homo sapiens
HGGGARLDL

SEQ ID NO: 2698 - protein, 9 aa, Homo sapiens
AFILSAEKK

SEQ ID NO: 2699 - protein, 9 aa, Homo sapiens
PGAAPRDMM

SEQ ID NO: 2700 - protein, 9 aa, Homo sapiens
NFSNFILDK

SEQ ID NO: 2701 - protein, 9 aa, Homo sapiens
REFEQLNRN

SEQ ID NO: 2702 - protein, 9 aa, Homo sapiens
TVGAGSLVD

SEQ ID NO: 2703 - protein, 9 aa, Homo sapiens
AVCFGCRYS

SEQ ID NO: 2704 - protein, 9 aa, Homo sapiens
PLTVVAVAN

SEQ ID NO: 2705 - protein, 9 aa, Homo sapiens
DPRPLTVVA

SEQ ID NO: 2706 - protein, 9 aa, Homo sapiens
GAFLDPRPL

SEQ ID NO: 2707 - protein, 9 aa, Homo sapiens
DGAFLDPRP

SEQ ID NO: 2708 - protein, 9 aa, Homo sapiens
ALLVRGSAD

SEQ ID NO: 2709 - protein, 9 aa, Homo sapiens
VLSEARELV

SEQ ID NO: 2710 - protein, 9 aa, Homo sapiens
NFFTRQPRS

SEQ ID NO: 2711 - protein, 9 aa, Homo sapiens
AHSMMRNFF

SEQ ID NO: 2712 - protein, 9 aa, Homo sapiens
QRRAAHSMM

SEQ ID NO: 2713 - protein, 9 aa, Homo sapiens
MAFGHYSEH

SEQ ID NO: 2714 - protein, 9 aa, Homo sapiens
GERAIHQAL

SEQ ID NO: 2715 - protein, 9 aa, Homo sapiens
QIRLGSCPI

SEQ ID NO: 2716 - protein, 9 aa, Homo sapiens
YGDVFQIRL

SEQ ID NO: 2717 - protein, 9 aa, Homo sapiens
LARRYGDVF

SEQ ID NO: 2718 - protein, 9 aa, Homo sapiens
PPGPFAWPL

SEQ ID NO: 2719 - protein, 9 aa, Homo sapiens
LRSAPPGPF

SEQ ID NO: 2720 - protein, 9 aa, Homo sapiens
RLLRQRRRQ

SEQ ID NO: 2721 - protein, 9 aa, Homo sapiens
LLLLLSVLA

SEQ ID NO: 2722 - protein, 9 aa, Homo sapiens
DPWPLNPLS

SEQ ID NO: 2723 - protein, 9 aa, Homo sapiens
NLQAKETCQ

SEQ ID NO: 2724 - protein, 9 aa, Homo sapiens
DSAVQNLQA

SEQ ID NO: 2725 - protein, 9 aa, Homo sapiens
AKMNFSYGL

SEQ ID NO: 2726 - protein, 9 aa, Homo sapiens
KRRCIGEEL

SEQ ID NO: 2727 - protein, 9 aa, Homo sapiens
NKDLTSRVM

SEQ ID NO: 2728 - protein, 9 aa, Homo sapiens
NFDPARFLD

SEQ ID NO: 2729 - protein, 9 aa, Homo sapiens
MRFSSFVPV

SEQ ID NO: 2730 - protein, 9 aa, Homo sapiens
LSTALQWLL

SEQ ID NO: 2731 - protein, 9 aa, Homo sapiens
ILSAEKKAA

SEQ ID NO: 2732 - protein, 9 aa, Homo sapiens
FLRHCESLR

SEQ ID NO: 2733 - protein, 9 aa, Homo sapiens
DKFLRHCES

SEQ ID NO: 2734 - protein, 9 aa, Homo sapiens
NRNFSNFIL

SEQ ID NO: 2735 - protein, 9 aa, Homo sapiens
VFREFEQLN

SEQ ID NO: 2736 - protein, 9 aa, Homo sapiens
VGAGSLVDV

SEQ ID NO: 2737 - protein, 9 aa, Homo sapiens
GRTVGAGSL

SEQ ID NO: 2738 - protein, 9 aa, Homo sapiens
RGSADGAFL

SEQ ID NO: 2739 - protein, 9 aa, Homo sapiens
LLVRGSADG

SEQ ID NO: 2740 - protein, 9 aa, Homo sapiens
VQRRAAHSM

SEQ ID NO: 2741 - protein, 9 aa, Homo sapiens
AFASFRVVS

SEQ ID NO: 2742 - protein, 9 aa, Homo sapiens
AFADRPAFA

SEQ ID NO: 2743 - protein, 9 aa, Homo sapiens
RLGSCPIVV

SEQ ID NO: 2744 - protein, 9 aa, Homo sapiens
HLSFARLAR

SEQ ID NO: 2745 - protein, 9 aa, Homo sapiens
LLSVLATVH

SEQ ID NO: 2746 - protein, 9 aa, Homo sapiens
LSPNDPWPL

SEQ ID NO: 2747 - protein, 9 aa, Homo sapiens
VMIFSVGKR

SEQ ID NO: 2748 - protein, 9 aa, Homo sapiens
KDGLINKDL

SEQ ID NO: 2749 - protein, 9 aa, Homo sapiens
RFLDKDGLI

SEQ ID NO: 2750 - protein, 9 aa, Homo sapiens
QWSVNHDPL

SEQ ID NO: 2751 - protein, 9 aa, Homo sapiens
VFVNQWSVN

SEQ ID NO: 2752 - protein, 9 aa, Homo sapiens
SFVPVTIPH

SEQ ID NO: 2753 - protein, 9 aa, Homo sapiens
AELDQVVGR

SEQ ID NO: 2754 - protein, 9 aa, Homo sapiens
LLLFTRYPD

SEQ ID NO: 2755 - protein, 9 aa, Homo sapiens
LLLLFTRYP

SEQ ID NO: 2756 - protein, 9 aa, Homo sapiens
ENVPATITD

SEQ ID NO: 2757 - protein, 9 aa, Homo sapiens
LDLENVPAT

SEQ ID NO: 2758 - protein, 9 aa, Homo sapiens
EKKAAGDSH

SEQ ID NO: 2759 - protein, 9 aa, Homo sapiens
RDMMDAFIL

SEQ ID NO: 2760 - protein, 9 aa, Homo sapiens
RPGAAPRDM

SEQ ID NO: 2761 - protein, 9 aa, Homo sapiens
ESLRPGAAP

SEQ ID NO: 2762 - protein, 9 aa, Homo sapiens
NFILDKFLR

SEQ ID NO: 2763 - protein, 9 aa, Homo sapiens
WLQYFPNPV

SEQ ID NO: 2764 - protein, 9 aa, Homo sapiens
LLSHNEEFG

SEQ ID NO: 2765 - protein, 9 aa, Homo sapiens
AFLDPRPLT

SEQ ID NO: 2766 - protein, 9 aa, Homo sapiens
EGHVLSEAR

SEQ ID NO: 2767 - protein, 9 aa, Homo sapiens
RQVLEGHVL

SEQ ID NO: 2768 - protein, 9 aa, Homo sapiens
FFTRQPRSR

SEQ ID NO: 2769 - protein, 9 aa, Homo sapiens
RAAHSMMRN

SEQ ID NO: 2770 - protein, 9 aa, Homo sapiens
EHWKVQRRA

SEQ ID NO: 2771 - protein, 9 aa, Homo sapiens
ASFRVVSGG

SEQ ID NO: 2772 - protein, 9 aa, Homo sapiens
DRPAFASFR

SEQ ID NO: 2773 - protein, 9 aa, Homo sapiens
ERAIHQALV

SEQ ID NO: 2774 - protein, 9 aa, Homo sapiens
LSFARLARR

SEQ ID NO: 2775 - protein, 9 aa, Homo sapiens
FAWPLIGNA

SEQ ID NO: 2776 - protein, 9 aa, Homo sapiens
APPGPFAWP

SEQ ID NO: 2777 - protein, 9 aa, Homo sapiens
LNPLSIQQT

SEQ ID NO: 2778 - protein, 9 aa, Homo sapiens
SAVQNLQAK

SEQ ID NO: 2779 - protein, 9 aa, Homo sapiens
IKPKSFKVN

SEQ ID NO: 2780 - protein, 9 aa, Homo sapiens
IFSVGKRRC

SEQ ID NO: 2781 - protein, 9 aa, Homo sapiens
LDKDGLINK

SEQ ID NO: 2782 - protein, 9 aa, Homo sapiens
PNPENFDPA

SEQ ID NO: 2783 - protein, 9 aa, Homo sapiens
DPLKWPNPE

SEQ ID NO: 2784 - protein, 9 aa, Homo sapiens
IPKDTVVFV

SEQ ID NO: 2785 - protein, 9 aa, Homo sapiens
EAMRFSSFV

SEQ ID NO: 2786 - protein, 9 aa, Homo sapiens
GDQPNLPYV

SEQ ID NO: 2787 - protein, 9 aa, Homo sapiens
TRYPDVQTR

SEQ ID NO: 2788 - protein, 9 aa, Homo sapiens
MDAFILSAE

SEQ ID NO: 2789 - protein, 9 aa, Homo sapiens
RHCESLRPG

SEQ ID NO: 2790 - protein, 9 aa, Homo sapiens
RNFSNFILD

SEQ ID NO: 2791 - protein, 9 aa, Homo sapiens
EQLNRNFSN

SEQ ID NO: 2792 - protein, 9 aa, Homo sapiens
PWLQYFPNP

SEQ ID NO: 2793 - protein, 9 aa, Homo sapiens
SHNEEFGRT

SEQ ID NO: 2794 - protein, 9 aa, Homo sapiens
PEFRELLSH

SEQ ID NO: 2795 - protein, 9 aa, Homo sapiens
PRPLTVVAV

SEQ ID NO: 2796 - protein, 9 aa, Homo sapiens
SADGAFLDP

SEQ ID NO: 2797 - protein, 9 aa, Homo sapiens
SEHWKVQRR

SEQ ID NO: 2798 - protein, 9 aa, Homo sapiens
AFGHYSEHW

SEQ ID NO: 2799 - protein, 9 aa, Homo sapiens
SFRVVSGGR

SEQ ID NO: 2800 - protein, 9 aa, Homo sapiens
PAFASFRVV

SEQ ID NO: 2801 - protein, 9 aa, Homo sapiens
IHQALVQQG

SEQ ID NO: 2802 - protein, 9 aa, Homo sapiens
CPIVVLNGE

SEQ ID NO: 2803 - protein, 9 aa, Homo sapiens
GSCPIVVLN

SEQ ID NO: 2804 - protein, 9 aa, Homo sapiens
RRYGDVFQI

SEQ ID NO: 2805 - protein, 9 aa, Homo sapiens
PAKMNFSYG

SEQ ID NO: 2806 - protein, 9 aa, Homo sapiens
NEPAKMNFS

SEQ ID NO: 2807 - protein, 9 aa, Homo sapiens
LFLFISILA

SEQ ID NO: 2808 - protein, 9 aa, Homo sapiens
MQLFLFISI

SEQ ID NO: 2809 - protein, 9 aa, Homo sapiens
SKMQLFLFI

SEQ ID NO: 2810 - protein, 9 aa, Homo sapiens
DGLINKDLT

SEQ ID NO: 2811 - protein, 9 aa, Homo sapiens
VNQWSVNHD

SEQ ID NO: 2812 - protein, 9 aa, Homo sapiens
KDTVVFVNQ

SEQ ID NO: 2813 - protein, 9 aa, Homo sapiens
SSFVPVTIP

SEQ ID NO: 2814 - protein, 9 aa, Homo sapiens
LFTRYPDVQ

SEQ ID NO: 2815 - protein, 9 aa, Homo sapiens
ASQDTLSTA

SEQ ID NO: 2816 - protein, 9 aa, Homo sapiens
LSAEKKAAG

SEQ ID NO: 2817 - protein, 9 aa, Homo sapiens
MMDAFILSA

SEQ ID NO: 2818 - protein, 9 aa, Homo sapiens
AAPRDMMDA

SEQ ID NO: 2819 - protein, 9 aa, Homo sapiens
QYFPNPVRT

SEQ ID NO: 2820 - protein, 9 aa, Homo sapiens
DPEFRELLS

SEQ ID NO: 2821 - protein, 9 aa, Homo sapiens
VAVANVMSA

SEQ ID NO: 2822 - protein, 9 aa, Homo sapiens
LEGHVLSEA

SEQ ID NO: 2823 - protein, 9 aa, Homo sapiens
RSRQVLEGH

SEQ ID NO: 2824 - protein, 9 aa, Homo sapiens
PRSRQVLEG

SEQ ID NO: 2825 - protein, 9 aa, Homo sapiens
SGGRSMAFG

SEQ ID NO: 2826 - protein, 9 aa, Homo sapiens
FASFRVVSG

SEQ ID NO: 2827 - protein, 9 aa, Homo sapiens
QQGSAFADR

SEQ ID NO: 2828 - protein, 9 aa, Homo sapiens
SCPIVVLNG

SEQ ID NO: 2829 - protein, 9 aa, Homo sapiens
RYGDVFQIR

SEQ ID NO: 2830 - protein, 9 aa, Homo sapiens
GQAAHLSFA

SEQ ID NO: 2831 - protein, 9 aa, Homo sapiens
GNAAAVGQA

SEQ ID NO: 2832 - protein, 9 aa, Homo sapiens
QRRRQLRSA

SEQ ID NO: 2833 - protein, 9 aa, Homo sapiens
VGQRLLRQR

SEQ ID NO: 2834 - protein, 9 aa, Homo sapiens
PKSFKVNVT

SEQ ID NO: 2835 - protein, 9 aa, Homo sapiens
KMNFSYGLT

SEQ ID NO: 2836 - protein, 9 aa, Homo sapiens
AHQCDFRAN

SEQ ID NO: 2837 - protein, 9 aa, Homo sapiens
RCIGEELSK

SEQ ID NO: 2838 - protein, 9 aa, Homo sapiens
GKRRCIGEE

SEQ ID NO: 2839 - protein, 9 aa, Homo sapiens
SRVMIFSVG

SEQ ID NO: 2840 - protein, 9 aa, Homo sapiens
TSRVMIFSV

SEQ ID NO: 2841 - protein, 9 aa, Homo sapiens
INKDLTSRV

SEQ ID NO: 2842 - protein, 9 aa, Homo sapiens
FDPARFLDK

SEQ ID NO: 2843 - protein, 9 aa, Homo sapiens
VNHDPLKWP

SEQ ID NO: 2844 - protein, 9 aa, Homo sapiens
PKDTVVFVN

SEQ ID NO: 2845 - protein, 9 aa, Homo sapiens
YHIPKDTVV

SEQ ID NO: 2846 - protein, 9 aa, Homo sapiens
ANTSVLGYH

SEQ ID NO: 2847 - protein, 9 aa, Homo sapiens
QPNLPYVLA

SEQ ID NO: 2848 - protein, 9 aa, Homo sapiens
VQAELDQVV

SEQ ID NO: 2849 - protein, 9 aa, Homo sapiens
QWLLLLFTR

SEQ ID NO: 2850 - protein, 9 aa, Homo sapiens
LQWLLLLFT

SEQ ID NO: 2851 - protein, 9 aa, Homo sapiens
GARLDLENV

SEQ ID NO: 2852 - protein, 9 aa, Homo sapiens
GAAPRDMMD

SEQ ID NO: 2853 - protein, 9 aa, Homo sapiens
LRPGAAPRD

SEQ ID NO: 2854 - protein, 9 aa, Homo sapiens
NPVRTVFRE

SEQ ID NO: 2855 - protein, 9 aa, Homo sapiens
MPWLQYFPN

SEQ ID NO: 2856 - protein, 9 aa, Homo sapiens
GSLVDVMPW

SEQ ID NO: 2857 - protein, 9 aa, Homo sapiens
VCFGCRYSH

SEQ ID NO: 2858 - protein, 9 aa, Homo sapiens
MSAVCFGCR

SEQ ID NO: 2859 - protein, 9 aa, Homo sapiens
RPLTVVAVA

SEQ ID NO: 2860 - protein, 9 aa, Homo sapiens
LDPRPLTVV

SEQ ID NO: 2861 - protein, 9 aa, Homo sapiens
MMRNFFTRQ

SEQ ID NO: 2862 - protein, 9 aa, Homo sapiens
NGERAIHQA

SEQ ID NO: 2863 - protein, 9 aa, Homo sapiens
GDVFQIRLG

SEQ ID NO: 2864 - protein, 9 aa, Homo sapiens
LATVHVGQR

SEQ ID NO: 2865 - protein, 9 aa, Homo sapiens
WPLNPLSIQ

SEQ ID NO: 2866 - protein, 9 aa, Homo sapiens
RESMELLDS

SEQ ID NO: 2867 - protein, 9 aa, Homo sapiens
KPKSFKVNV

SEQ ID NO: 2868 - protein, 9 aa, Homo sapiens
SYGLTIKPK

SEQ ID NO: 2869 - protein, 9 aa, Homo sapiens
FSYGLTIKP

SEQ ID NO: 2870 - protein, 9 aa, Homo sapiens
RANPNEPAK

SEQ ID NO: 2871 - protein, 9 aa, Homo sapiens
CDFRANPNE

SEQ ID NO: 2872 - protein, 9 aa, Homo sapiens
KMQLFLFIS

SEQ ID NO: 2873 - protein, 9 aa, Homo sapiens
IGEELSKMQ

SEQ ID NO: 2874 - protein, 9 aa, Homo sapiens
HDPLKWPNP

SEQ ID NO: 2875 - protein, 9 aa, Homo sapiens
NHDPLKWPN

SEQ ID NO: 2876 - protein, 9 aa, Homo sapiens
TSVLGYHIP

SEQ ID NO: 2877 - protein, 9 aa, Homo sapiens
LAFLYEAMR

SEQ ID NO: 2878 - protein, 9 aa, Homo sapiens
PYVLAFLYE

SEQ ID NO: 2879 - protein, 9 aa, Homo sapiens
TDIFGASQD

SEQ ID NO: 2880 - protein, 9 aa, Homo sapiens
GGGARLDLE

SEQ ID NO: 2881 - protein, 9 aa, Homo sapiens
KAAGDSHGG

SEQ ID NO: 2882 - protein, 9 aa, Homo sapiens
SAEKKAAGD

SEQ ID NO: 2883 - protein, 9 aa, Homo sapiens
HCESLRPGA

SEQ ID NO: 2884 - protein, 9 aa, Homo sapiens
ADGAFLDPR

SEQ ID NO: 2885 - protein, 9 aa, Homo sapiens
RELVALLVR

SEQ ID NO: 2886 - protein, 9 aa, Homo sapiens
SMMRNFFTR

SEQ ID NO: 2887 - protein, 9 aa, Homo sapiens
VQQGSAFAD

SEQ ID NO: 2888 - protein, 9 aa, Homo sapiens
IRLGSCPIV

SEQ ID NO: 2889 - protein, 9 aa, Homo sapiens
FQIRLGSCP

SEQ ID NO: 2890 - protein, 9 aa, Homo sapiens
SAPPGPFAW

SEQ ID NO: 2891 - protein, 9 aa, Homo sapiens
RSAPPGPFA

SEQ ID NO: 2892 - protein, 9 aa, Homo sapiens
RRRQLRSAP

SEQ ID NO: 2893 - protein, 9 aa, Homo sapiens
PNDPWPLNP

SEQ ID NO: 2894 - protein, 9 aa, Homo sapiens
MGTSLSPND

SEQ ID NO: 2895 - protein, 9 aa, Homo sapiens
SMELLDSAV

SEQ ID NO: 2896 - protein, 9 aa, Homo sapiens
MNFSYGLTI

SEQ ID NO: 2897 - protein, 9 aa, Homo sapiens
NPNEPAKMN

SEQ ID NO: 2898 - protein, 9 aa, Homo sapiens
HQCDFRANP

SEQ ID NO: 2899 - protein, 9 aa, Homo sapiens
ISILAHQCD

SEQ ID NO: 2900 - protein, 9 aa, Homo sapiens
FSVGKRRCI

SEQ ID NO: 2901 - protein, 9 aa, Homo sapiens
KDLTSRVMI

SEQ ID NO: 2902 - protein, 9 aa, Homo sapiens
GRDRLPCMG

SEQ ID NO: 2903 - protein, 9 aa, Homo sapiens
PDVQTRVQA

SEQ ID NO: 2904 - protein, 9 aa, Homo sapiens
RYPDVQTRV

SEQ ID NO: 2905 - protein, 9 aa, Homo sapiens
FGASQDTLS

SEQ ID NO: 2906 - protein, 9 aa, Homo sapiens
GGARLDLEN

SEQ ID NO: 2907 - protein, 9 aa, Homo sapiens
AGDSHGGGA

SEQ ID NO: 2908 - protein, 9 aa, Homo sapiens
AAGDSHGGG

SEQ ID NO: 2909 - protein, 9 aa, Homo sapiens
KKAAGDSHG

SEQ ID NO: 2910 - protein, 9 aa, Homo sapiens
SHDDPEFRE

SEQ ID NO: 2911 - protein, 9 aa, Homo sapiens
GHVLSEARE

SEQ ID NO: 2912 - protein, 9 aa, Homo sapiens
TRQPRSRQV

SEQ ID NO: 2913 - protein, 9 aa, Homo sapiens
RNFFTRQPR

SEQ ID NO: 2914 - protein, 9 aa, Homo sapiens
RRAAHSMMR

SEQ ID NO: 2915 - protein, 9 aa, Homo sapiens
WKVQRRAAH

SEQ ID NO: 2916 - protein, 9 aa, Homo sapiens
HWKVQRRAA

SEQ ID NO: 2917 - protein, 9 aa, Homo sapiens
HQALVQQGS

SEQ ID NO: 2918 - protein, 9 aa, Homo sapiens
RAIHQALVQ

SEQ ID NO: 2919 - protein, 9 aa, Homo sapiens
LNGERAIHQ

SEQ ID NO: 2920 - protein, 9 aa, Homo sapiens
QAAHLSFAR

SEQ ID NO: 2921 - protein, 9 aa, Homo sapiens
AAAVGQAAH

SEQ ID NO: 2922 - protein, 9 aa, Homo sapiens
NAAAVGQAA

SEQ ID NO: 2923 - protein, 9 aa, Homo sapiens
GQRLLRQRR

SEQ ID NO: 2924 - protein, 9 aa, Homo sapiens
VHVGQRLLR

SEQ ID NO: 2925 - protein, 9 aa, Homo sapiens
VQNLQAKET

SEQ ID NO: 2926 - protein, 9 aa, Homo sapiens
YGLTIKPKS

SEQ ID NO: 2927 - protein, 9 aa, Homo sapiens
LAHQCDFRA

SEQ ID NO: 2928 - protein, 9 aa, Homo sapiens
VGKRRCIGE

SEQ ID NO: 2929 - protein, 9 aa, Homo sapiens
NPENFDPAR

SEQ ID NO: 2930 - protein, 9 aa, Homo sapiens
WPNPENFDP

SEQ ID NO: 2931 - protein, 9 aa, Homo sapiens
IPHATTANT

SEQ ID NO: 2932 - protein, 9 aa, Homo sapiens
CMGDQPNLP

SEQ ID NO: 2933 - protein, 9 aa, Homo sapiens
RDRLPCMGD

SEQ ID NO: 2934 - protein, 9 aa, Homo sapiens
YPDVQTRVQ

SEQ ID NO: 2935 - protein, 9 aa, Homo sapiens
QDTLSTALQ

SEQ ID NO: 2936 - protein, 9 aa, Homo sapiens
GASQDTLST

SEQ ID NO: 2937 - protein, 9 aa, Homo sapiens
ARLDLENVP

SEQ ID NO: 2938 - protein, 9 aa, Homo sapiens
SHGGGARLD

SEQ ID NO: 2939 - protein, 9 aa, Homo sapiens
AEKKAAGDS

SEQ ID NO: 2940 - protein, 9 aa, Homo sapiens
PRDMMDAFI

SEQ ID NO: 2941 - protein, 9 aa, Homo sapiens
LDKFLRHCE

SEQ ID NO: 2942 - protein, 9 aa, Homo sapiens
PNPVRTVFR

SEQ ID NO: 2943 - protein, 9 aa, Homo sapiens
VMPWLQYFP

SEQ ID NO: 2944 - protein, 9 aa, Homo sapiens
AGSLVDVMP

SEQ ID NO: 2945 - protein, 9 aa, Homo sapiens
FGRTVGAGS

SEQ ID NO: 2946 - protein, 9 aa, Homo sapiens
HNEEFGRTV

SEQ ID NO: 2947 - protein, 9 aa, Homo sapiens
RELLSHNEE

SEQ ID NO: 2948 - protein, 9 aa, Homo sapiens
FRELLSHNE

SEQ ID NO: 2949 - protein, 9 aa, Homo sapiens
GSADGAFLD

SEQ ID NO: 2950 - protein, 9 aa, Homo sapiens
SRQVLEGHV

SEQ ID NO: 2951 - protein, 9 aa, Homo sapiens
QPRSRQVLE

SEQ ID NO: 2952 - protein, 9 aa, Homo sapiens
YSEHWKVQR

SEQ ID NO: 2953 - protein, 9 aa, Homo sapiens
HYSEHWKVQ

SEQ ID NO: 2954 - protein, 9 aa, Homo sapiens
GHYSEHWKV

SEQ ID NO: 2955 - protein, 9 aa, Homo sapiens
SMAFGHYSE

SEQ ID NO: 2956 - protein, 9 aa, Homo sapiens
GGRSMAFGH

SEQ ID NO: 2957 - protein, 9 aa, Homo sapiens
FRVVSGGRS

SEQ ID NO: 2958 - protein, 9 aa, Homo sapiens
RPAFASFRV

SEQ ID NO: 2959 - protein, 9 aa, Homo sapiens
FADRPAFAS

SEQ ID NO: 2960 - protein, 9 aa, Homo sapiens
QALVQQGSA

SEQ ID NO: 2961 - protein, 9 aa, Homo sapiens
IGNAAAVGQ

SEQ ID NO: 2962 - protein, 9 aa, Homo sapiens
WPLIGNAAA

SEQ ID NO: 2963 - protein, 9 aa, Homo sapiens
AWPLIGNAA

SEQ ID NO: 2964 - protein, 9 aa, Homo sapiens
GPFAWPLIG

SEQ ID NO: 2965 - protein, 9 aa, Homo sapiens
PGPFAWPLI

SEQ ID NO: 2966 - protein, 9 aa, Homo sapiens
RQLRSAPPG

SEQ ID NO: 2967 - protein, 9 aa, Homo sapiens
LSVLATVHV

SEQ ID NO: 2968 - protein, 9 aa, Homo sapiens
NPLSIQQTT

SEQ ID NO: 2969 - protein, 9 aa, Homo sapiens
PWPLNPLSI

SEQ ID NO: 2970 - protein, 9 aa, Homo sapiens
SPNDPWPLN

SEQ ID NO: 2971 - protein, 9 aa, Homo sapiens
QNLQAKETC

SEQ ID NO: 2972 - protein, 9 aa, Homo sapiens
MELLDSAVQ

SEQ ID NO: 2973 - protein, 9 aa, Homo sapiens
LRESMELLD

SEQ ID NO: 2974 - protein, 9 aa, Homo sapiens
FKVNVTLRE

SEQ ID NO: 2975 - protein, 9 aa, Homo sapiens
FRANPNEPA

SEQ ID NO: 2976 - protein, 9 aa, Homo sapiens
QCDFRANPN

SEQ ID NO: 2977 - protein, 9 aa, Homo sapiens
PARFLDKDG

SEQ ID NO: 2978 - protein, 9 aa, Homo sapiens
KWPNPENFD

SEQ ID NO: 2979 - protein, 9 aa, Homo sapiens
WSVNHDPLK

SEQ ID NO: 2980 - protein, 9 aa, Homo sapiens
NQWSVNHDP

SEQ ID NO: 2981 - protein, 9 aa, Homo sapiens
HATTANTSV

SEQ ID NO: 2982 - protein, 9 aa, Homo sapiens
PHATTANTS

SEQ ID NO: 2983 - protein, 9 aa, Homo sapiens
VPVTIPHAT

SEQ ID NO: 2984 - protein, 9 aa, Homo sapiens
FSSFVPVTI

SEQ ID NO: 2985 - protein, 9 aa, Homo sapiens
AMRFSSFVP

SEQ ID NO: 2986 - protein, 9 aa, Homo sapiens
LYEAMRFSS

SEQ ID NO: 2987 - protein, 9 aa, Homo sapiens
LPCMGDQPN

SEQ ID NO: 2988 - protein, 9 aa, Homo sapiens
QAELDQVVG

SEQ ID NO: 2989 - protein, 9 aa, Homo sapiens
TRVQAELDQ

SEQ ID NO: 2990 - protein, 9 aa, Homo sapiens
GDSHGGGAR

SEQ ID NO: 2991 - protein, 9 aa, Homo sapiens
CESLRPGAA

SEQ ID NO: 2992 - protein, 9 aa, Homo sapiens
LRHCESLRP

SEQ ID NO: 2993 - protein, 9 aa, Homo sapiens
FREFEQLNR

SEQ ID NO: 2994 - protein, 9 aa, Homo sapiens
LQYFPNPVR

SEQ ID NO: 2995 - protein, 9 aa, Homo sapiens
LSHNEEFGR

SEQ ID NO: 2996 - protein, 9 aa, Homo sapiens
YSHDDPEFR

SEQ ID NO: 2997 - protein, 9 aa, Homo sapiens
CRYSHDDPE

SEQ ID NO: 2998 - protein, 9 aa, Homo sapiens
GCRYSHDDP

SEQ ID NO: 2999 - protein, 9 aa, Homo sapiens
VMSAVCFGC

SEQ ID NO: 3000 - protein, 9 aa, Homo sapiens
VANVMSAVC

SEQ ID NO: 3001 - protein, 9 aa, Homo sapiens
VALLVRGSA

SEQ ID NO: 3002 - protein, 9 aa, Homo sapiens
MRNFFTRQP

SEQ ID NO: 3003 - protein, 9 aa, Homo sapiens
FGHYSEHWK

SEQ ID NO: 3004 - protein, 9 aa, Homo sapiens
GSAFADRPA

SEQ ID NO: 3005 - protein, 9 aa, Homo sapiens
QGSAFADRP

SEQ ID NO: 3006 - protein, 9 aa, Homo sapiens
ARRYGDVFQ

SEQ ID NO: 3007 - protein, 9 aa, Homo sapiens
ARLARRYGD

SEQ ID NO: 3008 - protein, 9 aa, Homo sapiens
AHLSFARLA

SEQ ID NO: 3009 - protein, 9 aa, Homo sapiens
RRQLRSAPP

SEQ ID NO: 3010 - protein, 9 aa, Homo sapiens
RQRRRQLRS

SEQ ID NO: 3011 - protein, 9 aa, Homo sapiens
LRQRRRQLR

SEQ ID NO: 3012 - protein, 9 aa, Homo sapiens
QRLLRQRRR

SEQ ID NO: 3013 - protein, 9 aa, Homo sapiens
TSLSPNDPW

SEQ ID NO: 3014 - protein, 10 aa, Homo sapiens
DTLSTALQWL

SEQ ID NO: 3015 - protein, 10 aa, Homo sapiens
ELLDSAVQNL

SEQ ID NO: 3016 - protein, 10 aa, Homo sapiens
ELSKMQLFLF

SEQ ID NO: 3017 - protein, 10 aa, Homo sapiens
DIFGASQDTL

SEQ ID NO: 3018 - protein, 10 aa, Homo sapiens
TTANTSVLGY

SEQ ID NO: 3019 - protein, 10 aa, Homo sapiens
DVQTRVQAEL

SEQ ID NO: 3020 - protein, 10 aa, Homo sapiens
VVSGGRSMAF

SEQ ID NO: 3021 - protein, 10 aa, Homo sapiens
DVFQIRLGSC

SEQ ID NO: 3022 - protein, 10 aa, Homo sapiens
YVLAFLYEAM

SEQ ID NO: 3023 - protein, 10 aa, Homo sapiens
VVGRDRLPCM

SEQ ID NO: 3024 - protein, 10 aa, Homo sapiens
STALQWLLLL

SEQ ID NO: 3025 - protein, 10 aa, Homo sapiens
RTVFREFEQL

SEQ ID NO: 3026 - protein, 10 aa, Homo sapiens
LVRGSADGAF

SEQ ID NO: 3027 - protein, 10 aa, Homo sapiens
TTLLLLLSVL

SEQ ID NO: 3028 - protein, 10 aa, Homo sapiens
SIQQTTLLLL

SEQ ID NO: 3029 - protein, 10 aa, Homo sapiens
VTLRESMELL

SEQ ID NO: 3030 - protein, 10 aa, Homo sapiens
EQLNRNFSNF

SEQ ID NO: 3031 - protein, 10 aa, Homo sapiens
LVDVMPWLQY

SEQ ID NO: 3032 - protein, 10 aa, Homo sapiens
RLGSCPIVVL

SEQ ID NO: 3033 - protein, 10 aa, Homo sapiens
AVGQAAHLSF

SEQ ID NO: 3034 - protein, 10 aa, Homo sapiens
NVPATITDIF

SEQ ID NO: 3035 - protein, 10 aa, Homo sapiens
NFSNFILDKF

SEQ ID NO: 3036 - protein, 10 aa, Homo sapiens
NVTLRESMEL

SEQ ID NO: 3037 - protein, 10 aa, Homo sapiens
PLKWPNPENF

SEQ ID NO: 3038 - protein, 10 aa, Homo sapiens
KVNVTLRESM

SEQ ID NO: 3039 - protein, 10 aa, Homo sapiens
DLTSRVMIFS

SEQ ID NO: 3040 - protein, 10 aa, Homo sapiens
NLPYVLAFLY

SEQ ID NO: 3041 - protein, 10 aa, Homo sapiens
ELVALLVRGS

SEQ ID NO: 3042 - protein, 10 aa, Homo sapiens
KVQRRAAHSM

SEQ ID NO: 3043 - protein, 10 aa, Homo sapiens
RLARRYGDVF

SEQ ID NO: 3044 - protein, 10 aa, Homo sapiens
QLRSAPPGPF

SEQ ID NO: 3045 - protein, 10 aa, Homo sapiens
RCIGEELSKM

SEQ ID NO: 3046 - protein, 10 aa, Homo sapiens
SVLGYHIPKD

SEQ ID NO: 3047 - protein, 10 aa, Homo sapiens
DVMPWLQYFP

SEQ ID NO: 3048 - protein, 10 aa, Homo sapiens
LTVVAVANVM

SEQ ID NO: 3049 - protein, 10 aa, Homo sapiens
ATVHVGQRLL

SEQ ID NO: 3050 - protein, 10 aa, Homo sapiens
SLSPNDPWPL

SEQ ID NO: 3051 - protein, 10 aa, Homo sapiens
TIKPKSFKVN

SEQ ID NO: 3052 - protein, 10 aa, Homo sapiens
DKDGLINKDL

SEQ ID NO: 3053 - protein, 10 aa, Homo sapiens
DTVVFVNQWS

SEQ ID NO: 3054 - protein, 10 aa, Homo sapiens
HIPKDTVVFV

SEQ ID NO: 3055 - protein, 10 aa, Homo sapiens
ATITDIFGAS

SEQ ID NO: 3056 - protein, 10 aa, Homo sapiens
DKFLRHCESL

SEQ ID NO: 3057 - protein, 10 aa, Homo sapiens
YFPNPVRTVF

SEQ ID NO: 3058 - protein, 10 aa, Homo sapiens
VVAVANVMSA

SEQ ID NO: 3059 - protein, 10 aa, Homo sapiens
QVLEGHVLSE

SEQ ID NO: 3060 - protein, 10 aa, Homo sapiens
FADRPAFASF

SEQ ID NO: 3061 - protein, 10 aa, Homo sapiens
AIHQALVQQG

SEQ ID NO: 3062 - protein, 10 aa, Homo sapiens
RLLRQRRRQL

SEQ ID NO: 3063 - protein, 10 aa, Homo sapiens
FLFISILAHQ

SEQ ID NO: 3064 - protein, 10 aa, Homo sapiens
FVNQWSVNHD

SEQ ID NO: 3065 - protein, 10 aa, Homo sapiens
LYEAMRFSSF

SEQ ID NO: 3066 - protein, 10 aa, Homo sapiens
ELDQVVGRDR

SEQ ID NO: 3067 - protein, 10 aa, Homo sapiens
TLSTALQWLL

SEQ ID NO: 3068 - protein, 10 aa, Homo sapiens
AAPRDMMDAF

SEQ ID NO: 3069 - protein, 10 aa, Homo sapiens
FILDKFLRHC

SEQ ID NO: 3070 - protein, 10 aa, Homo sapiens
VLEGHVLSEA

SEQ ID NO: 3071 - protein, 10 aa, Homo sapiens
RAAHSMMRNF

SEQ ID NO: 3072 - protein, 10 aa, Homo sapiens
GGRSMAFGHY

SEQ ID NO: 3073 - protein, 10 aa, Homo sapiens
HVGQRLLRQR

SEQ ID NO: 3074 - protein, 10 aa, Homo sapiens
PLSIQQTTLL

SEQ ID NO: 3075 - protein, 10 aa, Homo sapiens
PLNPLSIQQT

SEQ ID NO: 3076 - protein, 10 aa, Homo sapiens
EELSKMQLFL

SEQ ID NO: 3077 - protein, 10 aa, Homo sapiens
GEELSKMQLF

SEQ ID NO: 3078 - protein, 10 aa, Homo sapiens
RVMIFSVGKR

SEQ ID NO: 3079 - protein, 10 aa, Homo sapiens
LTSRVMIFSV

SEQ ID NO: 3080 - protein, 10 aa, Homo sapiens
KDLTSRVMIF

SEQ ID NO: 3081 - protein, 10 aa, Homo sapiens
GLINKDLTSR

SEQ ID NO: 3082 - protein, 10 aa, Homo sapiens
FLDKDGLINK

SEQ ID NO: 3083 - protein, 10 aa, Homo sapiens
YHIPKDTVVF

SEQ ID NO: 3084 - protein, 10 aa, Homo sapiens
VTIPHATTAN

SEQ ID NO: 3085 - protein, 10 aa, Homo sapiens
PNLPYVLAFL

SEQ ID NO: 3086 - protein, 10 aa, Homo sapiens
QPNLPYVLAF

SEQ ID NO: 3087 - protein, 10 aa, Homo sapiens
FTRYPDVQTR

SEQ ID NO: 3088 - protein, 10 aa, Homo sapiens
QWLLLLFTRY

SEQ ID NO: 3089 - protein, 10 aa, Homo sapiens
TALQWLLLLF

SEQ ID NO: 3090 - protein, 10 aa, Homo sapiens
RLDLENVPAT

SEQ ID NO: 3091 - protein, 10 aa, Homo sapiens
REFEQLNRNF

SEQ ID NO: 3092 - protein, 10 aa, Homo sapiens
NPVRTVFREF

SEQ ID NO: 3093 - protein, 10 aa, Homo sapiens
VDVMPWLQYF

SEQ ID NO: 3094 - protein, 10 aa, Homo sapiens
VGAGSLVDVM

SEQ ID NO: 3095 - protein, 10 aa, Homo sapiens
TVGAGSLVDV

SEQ ID NO: 3096 - protein, 10 aa, Homo sapiens
EEFGRTVGAG

SEQ ID NO: 3097 - protein, 10 aa, Homo sapiens
ELLSHNEEFG

SEQ ID NO: 3098 - protein, 10 aa, Homo sapiens
EFRELLSHNE

SEQ ID NO: 3099 - protein, 10 aa, Homo sapiens
SHDDPEFREL

SEQ ID NO: 3100 - protein, 10 aa, Homo sapiens
FLDPRPLTVV

SEQ ID NO: 3101 - protein, 10 aa, Homo sapiens
DGAFLDPRPL

SEQ ID NO: 3102 - protein, 10 aa, Homo sapiens
QAAHLSFARL

SEQ ID NO: 3103 - protein, 10 aa, Homo sapiens
QTTLLLLLSV

SEQ ID NO: 3104 - protein, 10 aa, Homo sapiens
PNDPWPLNPL

SEQ ID NO: 3105 - protein, 10 aa, Homo sapiens
LTIKPKSFKV

SEQ ID NO: 3106 - protein, 10 aa, Homo sapiens
NPNEPAKMNF

SEQ ID NO: 3107 - protein, 10 aa, Homo sapiens
MIFSVGKRRC

SEQ ID NO: 3108 - protein, 10 aa, Homo sapiens
SVNHDPLKWP

SEQ ID NO: 3109 - protein, 10 aa, Homo sapiens
NTSVLGYHIP

SEQ ID NO: 3110 - protein, 10 aa, Homo sapiens
SFVPVTIPHA

SEQ ID NO: 3111 - protein, 10 aa, Homo sapiens
LAFLYEAMRF

SEQ ID NO: 3112 - protein, 10 aa, Homo sapiens
DLENVPATIT

SEQ ID NO: 3113 - protein, 10 aa, Homo sapiens
EFGRTVGAGS

SEQ ID NO: 3114 - protein, 10 aa, Homo sapiens
PLTVVAVANV

SEQ ID NO: 3115 - protein, 10 aa, Homo sapiens
DPRPLTVVAV

SEQ ID NO: 3116 - protein, 10 aa, Homo sapiens
SEARELVALL

SEQ ID NO: 3117 - protein, 10 aa, Homo sapiens
LSEARELVAL

SEQ ID NO: 3118 - protein, 10 aa, Homo sapiens
AFASFRVVSG

SEQ ID NO: 3119 - protein, 10 aa, Homo sapiens
HLSFARLARR

SEQ ID NO: 3120 - protein, 10 aa, Homo sapiens
VLATVHVGQR

SEQ ID NO: 3121 - protein, 10 aa, Homo sapiens
DSAVQNLQAK

SEQ ID NO: 3122 - protein, 10 aa, Homo sapiens
EPAKMNFSYG

SEQ ID NO: 3123 - protein, 10 aa, Homo sapiens
MQLFLFISIL

SEQ ID NO: 3124 - protein, 10 aa, Homo sapiens
CIGEELSKMQ

SEQ ID NO: 3125 - protein, 10 aa, Homo sapiens
LINKDLTSRV

SEQ ID NO: 3126 - protein, 10 aa, Homo sapiens
NFDPARFLDK

SEQ ID NO: 3127 - protein, 10 aa, Homo sapiens
VVFVNQWSVN

SEQ ID NO: 3128 - protein, 10 aa, Homo sapiens
TIPHATTANT

SEQ ID NO: 3129 - protein, 10 aa, Homo sapiens
LLLFTRYPDV

SEQ ID NO: 3130 - protein, 10 aa, Homo sapiens
ITDIFGASQD

SEQ ID NO: 3131 - protein, 10 aa, Homo sapiens
TITDIFGASQ

SEQ ID NO: 3132 - protein, 10 aa, Homo sapiens
NFILDKFLRH

SEQ ID NO: 3133 - protein, 10 aa, Homo sapiens
EFEQLNRNFS

SEQ ID NO: 3134 - protein, 10 aa, Homo sapiens
TVFREFEQLN

SEQ ID NO: 3135 - protein, 10 aa, Homo sapiens
GSLVDVMPWL

SEQ ID NO: 3136 - protein, 10 aa, Homo sapiens
CRYSHDDPEF

SEQ ID NO: 3137 - protein, 10 aa, Homo sapiens
RVVSGGRSMA

SEQ ID NO: 3138 - protein, 10 aa, Homo sapiens
GSAFADRPAF

SEQ ID NO: 3139 - protein, 10 aa, Homo sapiens
LSFARLARRY

SEQ ID NO: 3140 - protein, 10 aa, Homo sapiens
PLIGNAAAVG

SEQ ID NO: 3141 - protein, 10 aa, Homo sapiens
LLLLSVLATV

SEQ ID NO: 3142 - protein, 10 aa, Homo sapiens
LLLLLSVLAT

SEQ ID NO: 3143 - protein, 10 aa, Homo sapiens
NEPAKMNFSY

SEQ ID NO: 3144 - protein, 10 aa, Homo sapiens
RANPNEPAKM

SEQ ID NO: 3145 - protein, 10 aa, Homo sapiens
DFRANPNEPA

SEQ ID NO: 3146 - protein, 10 aa, Homo sapiens
ISILAHQCDF

SEQ ID NO: 3147 - protein, 10 aa, Homo sapiens
IGEELSKMQL

SEQ ID NO: 3148 - protein, 10 aa, Homo sapiens
SVGKRRCIGE

SEQ ID NO: 3149 - protein, 10 aa, Homo sapiens
NPENFDPARF

SEQ ID NO: 3150 - protein, 10 aa, Homo sapiens
FVPVTIPHAT

SEQ ID NO: 3151 - protein, 10 aa, Homo sapiens
DQPNLPYVLA

SEQ ID NO: 3152 - protein, 10 aa, Homo sapiens
QVVGRDRLPC

SEQ ID NO: 3153 - protein, 10 aa, Homo sapiens
ALQWLLLLFT

SEQ ID NO: 3154 - protein, 10 aa, Homo sapiens
ENVPATITDI

SEQ ID NO: 3155 - protein, 10 aa, Homo sapiens
FILSAEKKAA

SEQ ID NO: 3156 - protein, 10 aa, Homo sapiens
DMMDAFILSA

SEQ ID NO: 3157 - protein, 10 aa, Homo sapiens
SLRPGAAPRD

SEQ ID NO: 3158 - protein, 10 aa, Homo sapiens
RTVGAGSLVD

SEQ ID NO: 3159 - protein, 10 aa, Homo sapiens
MSAVCFGCRY

SEQ ID NO: 3160 - protein, 10 aa, Homo sapiens
NVMSAVCFGC

SEQ ID NO: 3161 - protein, 10 aa, Homo sapiens
AVANVMSAVC

SEQ ID NO: 3162 - protein, 10 aa, Homo sapiens
TVVAVANVMS

SEQ ID NO: 3163 - protein, 10 aa, Homo sapiens
LVALLVRGSA

SEQ ID NO: 3164 - protein, 10 aa, Homo sapiens
FTRQPRSRQV

SEQ ID NO: 3165 - protein, 10 aa, Homo sapiens
LVQQGSAFAD

SEQ ID NO: 3166 - protein, 10 aa, Homo sapiens
QALVQQGSAF

SEQ ID NO: 3167 - protein, 10 aa, Homo sapiens
LIGNAAAVGQ

SEQ ID NO: 3168 - protein, 10 aa, Homo sapiens
PFAWPLIGNA

SEQ ID NO: 3169 - protein, 10 aa, Homo sapiens
SVLATVHVGQ

SEQ ID NO: 3170 - protein, 10 aa, Homo sapiens
IQQTTLLLLL

SEQ ID NO: 3171 - protein, 10 aa, Homo sapiens
AVQNLQAKET

SEQ ID NO: 3172 - protein, 10 aa, Homo sapiens
YGLTIKPKSF

SEQ ID NO: 3173 - protein, 10 aa, Homo sapiens
FISILAHQCD

SEQ ID NO: 3174 - protein, 10 aa, Homo sapiens
LFLFISILAH

SEQ ID NO: 3175 - protein, 10 aa, Homo sapiens
TVVFVNQWSV

SEQ ID NO: 3176 - protein, 10 aa, Homo sapiens
ATTANTSVLG

SEQ ID NO: 3177 - protein, 10 aa, Homo sapiens
FLYEAMRFSS

SEQ ID NO: 3178 - protein, 10 aa, Homo sapiens
VLAFLYEAMR

SEQ ID NO: 3179 - protein, 10 aa, Homo sapiens
CMGDQPNLPY

SEQ ID NO: 3180 - protein, 10 aa, Homo sapiens
RVQAELDQVV

SEQ ID NO: 3181 - protein, 10 aa, Homo sapiens
LRPGAAPRDM

SEQ ID NO: 3182 - protein, 10 aa, Homo sapiens
RELLSHNEEF

SEQ ID NO: 3183 - protein, 10 aa, Homo sapiens
DPEFRELLSH

SEQ ID NO: 3184 - protein, 10 aa, Homo sapiens
HDDPEFRELL

SEQ ID NO: 3185 - protein, 10 aa, Homo sapiens
AVCFGCRYSH

SEQ ID NO: 3186 - protein, 10 aa, Homo sapiens
VANVMSAVCF

SEQ ID NO: 3187 - protein, 10 aa, Homo sapiens
HVLSEARELV

SEQ ID NO: 3188 - protein, 10 aa, Homo sapiens
TRQPRSRQVL

SEQ ID NO: 3189 - protein, 10 aa, Homo sapiens
AAHSMMRNFF

SEQ ID NO: 3190 - protein, 10 aa, Homo sapiens
VLNGERAIHQ

SEQ ID NO: 3191 - protein, 10 aa, Homo sapiens
VVLNGERAIH

SEQ ID NO: 3192 - protein, 10 aa, Homo sapiens
IVVLNGERAI

SEQ ID NO: 3193 - protein, 10 aa, Homo sapiens
PIVVLNGERA

SEQ ID NO: 3194 - protein, 10 aa, Homo sapiens
QIRLGSCPIV

SEQ ID NO: 3195 - protein, 10 aa, Homo sapiens
AAAVGQAAHL

SEQ ID NO: 3196 - protein, 10 aa, Homo sapiens
APPGPFAWPL

SEQ ID NO: 3197 - protein, 10 aa, Homo sapiens
LSIQQTTLLL

SEQ ID NO: 3198 - protein, 10 aa, Homo sapiens
LLDSAVQNLQ

SEQ ID NO: 3199 - protein, 10 aa, Homo sapiens
ESMELLDSAV

SEQ ID NO: 3200 - protein, 10 aa, Homo sapiens
TLRESMELLD

SEQ ID NO: 3201 - protein, 10 aa, Homo sapiens
PAKMNFSYGL

SEQ ID NO: 3202 - protein, 10 aa, Homo sapiens
ILAHQCDFRA

SEQ ID NO: 3203 - protein, 10 aa, Homo sapiens
SILAHQCDFR

SEQ ID NO: 3204 - protein, 10 aa, Homo sapiens
LFISILAHQC

SEQ ID NO: 3205 - protein, 10 aa, Homo sapiens
QLFLFISILA

SEQ ID NO: 3206 - protein, 10 aa, Homo sapiens
INKDLTSRVM

SEQ ID NO: 3207 - protein, 10 aa, Homo sapiens
PVTIPHATTA

SEQ ID NO: 3208 - protein, 10 aa, Homo sapiens
AFLYEAMRFS

SEQ ID NO: 3209 - protein, 10 aa, Homo sapiens
GDQPNLPYVL

SEQ ID NO: 3210 - protein, 10 aa, Homo sapiens
LPCMGDQPNL

SEQ ID NO: 3211 - protein, 10 aa, Homo sapiens
RLPCMGDQPN

SEQ ID NO: 3212 - protein, 10 aa, Homo sapiens
QTRVQAELDQ

SEQ ID NO: 3213 - protein, 10 aa, Homo sapiens
LLFTRYPDVQ

SEQ ID NO: 3214 - protein, 10 aa, Homo sapiens
ASQDTLSTAL

SEQ ID NO: 3215 - protein, 10 aa, Homo sapiens
SHGGGARLDL

SEQ ID NO: 3216 - protein, 10 aa, Homo sapiens
GDSHGGGARL

SEQ ID NO: 3217 - protein, 10 aa, Homo sapiens
ILSAEKKAAG

SEQ ID NO: 3218 - protein, 10 aa, Homo sapiens
ILDKFLRHCE

SEQ ID NO: 3219 - protein, 10 aa, Homo sapiens
PVRTVFREFE

SEQ ID NO: 3220 - protein, 10 aa, Homo sapiens
VCFGCRYSHD

SEQ ID NO: 3221 - protein, 10 aa, Homo sapiens
VRGSADGAFL

SEQ ID NO: 3222 - protein, 10 aa, Homo sapiens
VLSEARELVA

SEQ ID NO: 3223 - protein, 10 aa, Homo sapiens
VQRRAAHSMM

SEQ ID NO: 3224 - protein, 10 aa, Homo sapiens
ALVQQGSAFA

SEQ ID NO: 3225 - protein, 10 aa, Homo sapiens
NGERAIHQAL

SEQ ID NO: 3226 - protein, 10 aa, Homo sapiens
RYGDVFQIRL

SEQ ID NO: 3227 - protein, 10 aa, Homo sapiens
LLRQRRRQLR

SEQ ID NO: 3228 - protein, 10 aa, Homo sapiens
TVHVGQRLLR

SEQ ID NO: 3229 - protein, 10 aa, Homo sapiens
LATVHVGQRL

SEQ ID NO: 3230 - protein, 10 aa, Homo sapiens
LLSVLATVHV

SEQ ID NO: 3231 - protein, 10 aa, Homo sapiens
GTSLSPNDPW

SEQ ID NO: 3232 - protein, 10 aa, Homo sapiens
PKSFKVNVTL

SEQ ID NO: 3233 - protein, 10 aa, Homo sapiens
GLTIKPKSFK

SEQ ID NO: 3234 - protein, 10 aa, Homo sapiens
GKRRCIGEEL

SEQ ID NO: 3235 - protein, 10 aa, Homo sapiens
PARFLDKDGL

SEQ ID NO: 3236 - protein, 10 aa, Homo sapiens
ENFDPARFLD

SEQ ID NO: 3237 - protein, 10 aa, Homo sapiens
DPLKWPNPEN

SEQ ID NO: 3238 - protein, 10 aa, Homo sapiens
NQWSVNHDPL

SEQ ID NO: 3239 - protein, 10 aa, Homo sapiens
HATTANTSVL

SEQ ID NO: 3240 - protein, 10 aa, Homo sapiens
DRLPCMGDQP

SEQ ID NO: 3241 - protein, 10 aa, Homo sapiens
LDQVVGRDRL

SEQ ID NO: 3242 - protein, 10 aa, Homo sapiens
EKKAAGDSHG

SEQ ID NO: 3243 - protein, 10 aa, Homo sapiens
AFILSAEKKA

SEQ ID NO: 3244 - protein, 10 aa, Homo sapiens
DAFILSAEKK

SEQ ID NO: 3245 - protein, 10 aa, Homo sapiens
PRDMMDAFIL

SEQ ID NO: 3246 - protein, 10 aa, Homo sapiens
RPGAAPRDMM

SEQ ID NO: 3247 - protein, 10 aa, Homo sapiens
FLRHCESLRP

SEQ ID NO: 3248 - protein, 10 aa, Homo sapiens
VFREFEQLNR

SEQ ID NO: 3249 - protein, 10 aa, Homo sapiens
WLQYFPNPVR

SEQ ID NO: 3250 - protein, 10 aa, Homo sapiens
SLVDVMPWLQ

SEQ ID NO: 3251 - protein, 10 aa, Homo sapiens
FGRTVGAGSL

SEQ ID NO: 3252 - protein, 10 aa, Homo sapiens
LLSHNEEFGR

SEQ ID NO: 3253 - protein, 10 aa, Homo sapiens
DDPEFRELLS

SEQ ID NO: 3254 - protein, 10 aa, Homo sapiens
LLVRGSADGA

SEQ ID NO: 3255 - protein, 10 aa, Homo sapiens
ALLVRGSADG

SEQ ID NO: 3256 - protein, 10 aa, Homo sapiens
GHVLSEAREL

SEQ ID NO: 3257 - protein, 10 aa, Homo sapiens
NFFTRQPRSR

SEQ ID NO: 3258 - protein, 10 aa, Homo sapiens
FRVVSGGRSM

SEQ ID NO: 3259 - protein, 10 aa, Homo sapiens
AFADRPAFAS

SEQ ID NO: 3260 - protein, 10 aa, Homo sapiens
LLLSVLATVH

SEQ ID NO: 3261 - protein, 10 aa, Homo sapiens
TLLLLLSVLA

SEQ ID NO: 3262 - protein, 10 aa, Homo sapiens
NPLSIQQTTL

SEQ ID NO: 3263 - protein, 10 aa, Homo sapiens
DPWPLNPLSI

SEQ ID NO: 3264 - protein, 10 aa, Homo sapiens
SFKVNVTLRE

SEQ ID NO: 3265 - protein, 10 aa, Homo sapiens
PENFDPARFL

SEQ ID NO: 3266 - protein, 10 aa, Homo sapiens
VFVNQWSVNH

SEQ ID NO: 3267 - protein, 10 aa, Homo sapiens
VLGYHIPKDT

SEQ ID NO: 3268 - protein, 10 aa, Homo sapiens
RFSSFVPVTI

SEQ ID NO: 3269 - protein, 10 aa, Homo sapiens
MRFSSFVPVT

SEQ ID NO: 3270 - protein, 10 aa, Homo sapiens
LFTRYPDVQT

SEQ ID NO: 3271 - protein, 10 aa, Homo sapiens
LLLLFTRYPD

SEQ ID NO: 3272 - protein, 10 aa, Homo sapiens
WLLLLFTRYP

SEQ ID NO: 3273 - protein, 10 aa, Homo sapiens
LSTALQWLLL

SEQ ID NO: 3274 - protein, 10 aa, Homo sapiens
DSHGGGARLD

SEQ ID NO: 3275 - protein, 10 aa, Homo sapiens
GAAPRDMMDA

SEQ ID NO: 3276 - protein, 10 aa, Homo sapiens
FSNFILDKFL

SEQ ID NO: 3277 - protein, 10 aa, Homo sapiens
LNRNFSNFIL

SEQ ID NO: 3278 - protein, 10 aa, Homo sapiens
QLNRNFSNFI

SEQ ID NO: 3279 - protein, 10 aa, Homo sapiens
QYFPNPVRTV

SEQ ID NO: 3280 - protein, 10 aa, Homo sapiens
PEFRELLSHN

SEQ ID NO: 3281 - protein, 10 aa, Homo sapiens
EARELVALLV

SEQ ID NO: 3282 - protein, 10 aa, Homo sapiens
EGHVLSEARE

SEQ ID NO: 3283 - protein, 10 aa, Homo sapiens
SRQVLEGHVL

SEQ ID NO: 3284 - protein, 10 aa, Homo sapiens
FFTRQPRSRQ

SEQ ID NO: 3285 - protein, 10 aa, Homo sapiens
EHWKVQRRAA

SEQ ID NO: 3286 - protein, 10 aa, Homo sapiens
DRPAFASFRV

SEQ ID NO: 3287 - protein, 10 aa, Homo sapiens
RAIHQALVQQ

SEQ ID NO: 3288 - protein, 10 aa, Homo sapiens
SAPPGPFAWP

SEQ ID NO: 3289 - protein, 10 aa, Homo sapiens
KSFKVNVTLR

SEQ ID NO: 3290 - protein, 10 aa, Homo sapiens
NFSYGLTIKP

SEQ ID NO: 3291 - protein, 10 aa, Homo sapiens
MNFSYGLTIK

SEQ ID NO: 3292 - protein, 10 aa, Homo sapiens
LDKDGLINKD

SEQ ID NO: 3293 - protein, 10 aa, Homo sapiens
RFLDKDGLIN

SEQ ID NO: 3294 - protein, 10 aa, Homo sapiens
DPARFLDKDG

SEQ ID NO: 3295 - protein, 10 aa, Homo sapiens
PKDTVVFVNQ

SEQ ID NO: 3296 - protein, 10 aa, Homo sapiens
MGDQPNLPYV

SEQ ID NO: 3297 - protein, 10 aa, Homo sapiens
PDVQTRVQAE

SEQ ID NO: 3298 - protein, 10 aa, Homo sapiens
MMDAFILSAE

SEQ ID NO: 3299 - protein, 10 aa, Homo sapiens
ESLRPGAAPR

SEQ ID NO: 3300 - protein, 10 aa, Homo sapiens
KFLRHCESLR

SEQ ID NO: 3301 - protein, 10 aa, Homo sapiens
RNFSNFILDK

SEQ ID NO: 3302 - protein, 10 aa, Homo sapiens
AFLDPRPLTV

SEQ ID NO: 3303 - protein, 10 aa, Homo sapiens
SADGAFLDPR

SEQ ID NO: 3304 - protein, 10 aa, Homo sapiens
RRAAHSMMRN

SEQ ID NO: 3305 - protein, 10 aa, Homo sapiens
SMAFGHYSEH

SEQ ID NO: 3306 - protein, 10 aa, Homo sapiens
VSGGRSMAFG

SEQ ID NO: 3307 - protein, 10 aa, Homo sapiens
SFRVVSGGRS

SEQ ID NO: 3308 - protein, 10 aa, Homo sapiens
VQQGSAFADR

SEQ ID NO: 3309 - protein, 10 aa, Homo sapiens
ERAIHQALVQ

SEQ ID NO: 3310 - protein, 10 aa, Homo sapiens
LNGERAIHQA

SEQ ID NO: 3311 - protein, 10 aa, Homo sapiens
GSCPIVVLNG

SEQ ID NO: 3312 - protein, 10 aa, Homo sapiens
VFQIRLGSCP

SEQ ID NO: 3313 - protein, 10 aa, Homo sapiens
RRYGDVFQIR

SEQ ID NO: 3314 - protein, 10 aa, Homo sapiens
SFARLARRYG

SEQ ID NO: 3315 - protein, 10 aa, Homo sapiens
GPFAWPLIGN

SEQ ID NO: 3316 - protein, 10 aa, Homo sapiens
VHVGQRLLRQ

SEQ ID NO: 3317 - protein, 10 aa, Homo sapiens
KPKSFKVNVT

SEQ ID NO: 3318 - protein, 10 aa, Homo sapiens
FSYGLTIKPK

SEQ ID NO: 3319 - protein, 10 aa, Homo sapiens
PNEPAKMNFS

SEQ ID NO: 3320 - protein, 10 aa, Homo sapiens
LAHQCDFRAN

SEQ ID NO: 3321 - protein, 10 aa, Homo sapiens
VGKRRCIGEE

SEQ ID NO: 3322 - protein, 10 aa, Homo sapiens
IFSVGKRRCI

SEQ ID NO: 3323 - protein, 10 aa, Homo sapiens
DGLINKDLTS

SEQ ID NO: 3324 - protein, 10 aa, Homo sapiens
FDPARFLDKD

SEQ ID NO: 3325 - protein, 10 aa, Homo sapiens
WPNPENFDPA

SEQ ID NO: 3326 - protein, 10 aa, Homo sapiens
IPKDTVVFVN

SEQ ID NO: 3327 - protein, 10 aa, Homo sapiens
EAMRFSSFVP

SEQ ID NO: 3328 - protein, 10 aa, Homo sapiens
DQVVGRDRLP

SEQ ID NO: 3329 - protein, 10 aa, Homo sapiens
AELDQVVGRD

SEQ ID NO: 3330 - protein, 10 aa, Homo sapiens
QAELDQVVGR

SEQ ID NO: 3331 - protein, 10 aa, Homo sapiens
TRVQAELDQV

SEQ ID NO: 3332 - protein, 10 aa, Homo sapiens
GASQDTLSTA

SEQ ID NO: 3333 - protein, 10 aa, Homo sapiens
IFGASQDTLS

SEQ ID NO: 3334 - protein, 10 aa, Homo sapiens
GGARLDLENV

SEQ ID NO: 3335 - protein, 10 aa, Homo sapiens
HGGGARLDLE

SEQ ID NO: 3336 - protein, 10 aa, Homo sapiens
PNPVRTVFRE

SEQ ID NO: 3337 - protein, 10 aa, Homo sapiens
MPWLQYFPNP

SEQ ID NO: 3338 - protein, 10 aa, Homo sapiens
CFGCRYSHDD

SEQ ID NO: 3339 - protein, 10 aa, Homo sapiens
VAVANVMSAV

SEQ ID NO: 3340 - protein, 10 aa, Homo sapiens
PRPLTVVAVA

SEQ ID NO: 3341 - protein, 10 aa, Homo sapiens
GSADGAFLDP

SEQ ID NO: 3342 - protein, 10 aa, Homo sapiens
RELVALLVRG

SEQ ID NO: 3343 - protein, 10 aa, Homo sapiens
QPRSRQVLEG

SEQ ID NO: 3344 - protein, 10 aa, Homo sapiens
YSEHWKVQRR

SEQ ID NO: 3345 - protein, 10 aa, Homo sapiens
AFGHYSEHWK

SEQ ID NO: 3346 - protein, 10 aa, Homo sapiens
FASFRVVSGG

SEQ ID NO: 3347 - protein, 10 aa, Homo sapiens
SCPIVVLNGE

SEQ ID NO: 3348 - protein, 10 aa, Homo sapiens
PWPLNPLSIQ

SEQ ID NO: 3349 - protein, 10 aa, Homo sapiens
RESMELLDSA

SEQ ID NO: 3350 - protein, 10 aa, Homo sapiens
LRESMELLDS

SEQ ID NO: 3351 - protein, 10 aa, Homo sapiens
FKVNVTLRES

SEQ ID NO: 3352 - protein, 10 aa, Homo sapiens
KMQLFLFISI

SEQ ID NO: 3353 - protein, 10 aa, Homo sapiens
SKMQLFLFIS

SEQ ID NO: 3354 - protein, 10 aa, Homo sapiens
LSKMQLFLFI

SEQ ID NO: 3355 - protein, 10 aa, Homo sapiens
TSRVMIFSVG

SEQ ID NO: 3356 - protein, 10 aa, Homo sapiens
PNPENFDPAR

SEQ ID NO: 3357 - protein, 10 aa, Homo sapiens
NHDPLKWPNP

SEQ ID NO: 3358 - protein, 10 aa, Homo sapiens
KDTVVFVNQW

SEQ ID NO: 3359 - protein, 10 aa, Homo sapiens
AMRFSSFVPV

SEQ ID NO: 3360 - protein, 10 aa, Homo sapiens
PYVLAFLYEA

SEQ ID NO: 3361 - protein, 10 aa, Homo sapiens
PATITDIFGA

SEQ ID NO: 3362 - protein, 10 aa, Homo sapiens
LSAEKKAAGD

SEQ ID NO: 3363 - protein, 10 aa, Homo sapiens
FREFEQLNRN

SEQ ID NO: 3364 - protein, 10 aa, Homo sapiens
VMPWLQYFPN

SEQ ID NO: 3365 - protein, 10 aa, Homo sapiens
AGSLVDVMPW

SEQ ID NO: 3366 - protein, 10 aa, Homo sapiens
LSHNEEFGRT

SEQ ID NO: 3367 - protein, 10 aa, Homo sapiens
PRSRQVLEGH

SEQ ID NO: 3368 - protein, 10 aa, Homo sapiens
SMMRNFFTRQ

SEQ ID NO: 3369 - protein, 10 aa, Homo sapiens
MAFGHYSEHW

SEQ ID NO: 3370 - protein, 10 aa, Homo sapiens
RPAFASFRVV

SEQ ID NO: 3371 - protein, 10 aa, Homo sapiens
LGSCPIVVLN

SEQ ID NO: 3372 - protein, 10 aa, Homo sapiens
YGDVFQIRLG

SEQ ID NO: 3373 - protein, 10 aa, Homo sapiens
ARRYGDVFQI

SEQ ID NO: 3374 - protein, 10 aa, Homo sapiens
VGQAAHLSFA

SEQ ID NO: 3375 - protein, 10 aa, Homo sapiens
IGNAAAVGQA

SEQ ID NO: 3376 - protein, 10 aa, Homo sapiens
RQRRRQLRSA

SEQ ID NO: 3377 - protein, 10 aa, Homo sapiens
IKPKSFKVNV

SEQ ID NO: 3378 - protein, 10 aa, Homo sapiens
AKMNFSYGLT

SEQ ID NO: 3379 - protein, 10 aa, Homo sapiens
TANTSVLGYH

SEQ ID NO: 3380 - protein, 10 aa, Homo sapiens
FSSFVPVTIP

SEQ ID NO: 3381 - protein, 10 aa, Homo sapiens
LPYVLAFLYE

SEQ ID NO: 3382 - protein, 10 aa, Homo sapiens
RDRLPCMGDQ

SEQ ID NO: 3383 - protein, 10 aa, Homo sapiens
VQAELDQVVG

SEQ ID NO: 3384 - protein, 10 aa, Homo sapiens
LQWLLLLFTR

SEQ ID NO: 3385 - protein, 10 aa, Homo sapiens
KAAGDSHGGG

SEQ ID NO: 3386 - protein, 10 aa, Homo sapiens
RDMMDAFILS

SEQ ID NO: 3387 - protein, 10 aa, Homo sapiens
RHCESLRPGA

SEQ ID NO: 3388 - protein, 10 aa, Homo sapiens
LRHCESLRPG

SEQ ID NO: 3389 - protein, 10 aa, Homo sapiens
NRNFSNFILD

SEQ ID NO: 3390 - protein, 10 aa, Homo sapiens
VMSAVCFGCR

SEQ ID NO: 3391 - protein, 10 aa, Homo sapiens
ANVMSAVCFG

SEQ ID NO: 3392 - protein, 10 aa, Homo sapiens
ARELVALLVR

SEQ ID NO: 3393 - protein, 10 aa, Homo sapiens
RNFFTRQPRS

SEQ ID NO: 3394 - protein, 10 aa, Homo sapiens
HSMMRNFFTR

SEQ ID NO: 3395 - protein, 10 aa, Homo sapiens
HYSEHWKVQR

SEQ ID NO: 3396 - protein, 10 aa, Homo sapiens
ARLARRYGDV

SEQ ID NO: 3397 - protein, 10 aa, Homo sapiens
RSAPPGPFAW

SEQ ID NO: 3398 - protein, 10 aa, Homo sapiens
LSVLATVHVG

SEQ ID NO: 3399 - protein, 10 aa, Homo sapiens
QQTTLLLLLS

SEQ ID NO: 3400 - protein, 10 aa, Homo sapiens
SAVQNLQAKE

SEQ ID NO: 3401 - protein, 10 aa, Homo sapiens
FRANPNEPAK

SEQ ID NO: 3402 - protein, 10 aa, Homo sapiens
CDFRANPNEP

SEQ ID NO: 3403 - protein, 10 aa, Homo sapiens
QCDFRANPNE

SEQ ID NO: 3404 - protein, 10 aa, Homo sapiens
VMIFSVGKRR

SEQ ID NO: 3405 - protein, 10 aa, Homo sapiens
NKDLTSRVMI

SEQ ID NO: 3406 - protein, 10 aa, Homo sapiens
GRDRLPCMGD

SEQ ID NO: 3407 - protein, 10 aa, Homo sapiens
YPDVQTRVQA

SEQ ID NO: 3408 - protein, 10 aa, Homo sapiens
TRYPDVQTRV

SEQ ID NO: 3409 - protein, 10 aa, Homo sapiens
FGASQDTLST

SEQ ID NO: 3410 - protein, 10 aa, Homo sapiens
TDIFGASQDT

SEQ ID NO: 3411 - protein, 10 aa, Homo sapiens
LDLENVPATI

SEQ ID NO: 3412 - protein, 10 aa, Homo sapiens
AGDSHGGGAR

SEQ ID NO: 3413 - protein, 10 aa, Homo sapiens
AEKKAAGDSH

SEQ ID NO: 3414 - protein, 10 aa, Homo sapiens
MDAFILSAEK

SEQ ID NO: 3415 - protein, 10 aa, Homo sapiens
PGAAPRDMMD

SEQ ID NO: 3416 - protein, 10 aa, Homo sapiens
FPNPVRTVFR

SEQ ID NO: 3417 - protein, 10 aa, Homo sapiens
GAGSLVDVMP

SEQ ID NO: 3418 - protein, 10 aa, Homo sapiens
GAFLDPRPLT

SEQ ID NO: 3419 - protein, 10 aa, Homo sapiens
WKVQRRAAHS

SEQ ID NO: 3420 - protein, 10 aa, Homo sapiens
HWKVQRRAAH

SEQ ID NO: 3421 - protein, 10 aa, Homo sapiens
ASFRVVSGGR

SEQ ID NO: 3422 - protein, 10 aa, Homo sapiens
PAFASFRVVS

SEQ ID NO: 3423 - protein, 10 aa, Homo sapiens
ADRPAFASFR

SEQ ID NO: 3424 - protein, 10 aa, Homo sapiens
SAFADRPAFA

SEQ ID NO: 3425 - protein, 10 aa, Homo sapiens
CPIVVLNGER

SEQ ID NO: 3426 - protein, 10 aa, Homo sapiens
NAAAVGQAAH

SEQ ID NO: 3427 - protein, 10 aa, Homo sapiens
GNAAAVGQAA

SEQ ID NO: 3428 - protein, 10 aa, Homo sapiens
AWPLIGNAAA

SEQ ID NO: 3429 - protein, 10 aa, Homo sapiens
FAWPLIGNAA

SEQ ID NO: 3430 - protein, 10 aa, Homo sapiens
PPGPFAWPLI

SEQ ID NO: 3431 - protein, 10 aa, Homo sapiens
MELLDSAVQN

SEQ ID NO: 3432 - protein, 10 aa, Homo sapiens
VNVTLRESME

SEQ ID NO: 3433 - protein, 10 aa, Homo sapiens
SYGLTIKPKS

SEQ ID NO: 3434 - protein, 10 aa, Homo sapiens
ANPNEPAKMN

SEQ ID NO: 3435 - protein, 10 aa, Homo sapiens
AHQCDFRANP

SEQ ID NO: 3436 - protein, 10 aa, Homo sapiens
FSVGKRRCIG

SEQ ID NO: 3437 - protein, 10 aa, Homo sapiens
SRVMIFSVGK

SEQ ID NO: 3438 - protein, 10 aa, Homo sapiens
ARFLDKDGLI

SEQ ID NO: 3439 - protein, 10 aa, Homo sapiens
LKWPNPENFD

SEQ ID NO: 3440 - protein, 10 aa, Homo sapiens
ANTSVLGYHI

SEQ ID NO: 3441 - protein, 10 aa, Homo sapiens
PHATTANTSV

SEQ ID NO: 3442 - protein, 10 aa, Homo sapiens
SSFVPVTIPH

SEQ ID NO: 3443 - protein, 10 aa, Homo sapiens
YEAMRFSSFV

SEQ ID NO: 3444 - protein, 10 aa, Homo sapiens
PCMGDQPNLP

SEQ ID NO: 3445 - protein, 10 aa, Homo sapiens
VGRDRLPCMG

SEQ ID NO: 3446 - protein, 10 aa, Homo sapiens
RYPDVQTRVQ

SEQ ID NO: 3447 - protein, 10 aa, Homo sapiens
SQDTLSTALQ

SEQ ID NO: 3448 - protein, 10 aa, Homo sapiens
ARLDLENVPA

SEQ ID NO: 3449 - protein, 10 aa, Homo sapiens
AAGDSHGGGA

SEQ ID NO: 3450 - protein, 10 aa, Homo sapiens
KKAAGDSHGG

SEQ ID NO: 3451 - protein, 10 aa, Homo sapiens
APRDMMDAFI

SEQ ID NO: 3452 - protein, 10 aa, Homo sapiens
CESLRPGAAP

SEQ ID NO: 3453 - protein, 10 aa, Homo sapiens
HCESLRPGAA

SEQ ID NO: 3454 - protein, 10 aa, Homo sapiens
LDKFLRHCES

SEQ ID NO: 3455 - protein, 10 aa, Homo sapiens
SNFILDKFLR

SEQ ID NO: 3456 - protein, 10 aa, Homo sapiens
LQYFPNPVRT

SEQ ID NO: 3457 - protein, 10 aa, Homo sapiens
NEEFGRTVGA

SEQ ID NO: 3458 - protein, 10 aa, Homo sapiens
HNEEFGRTVG

SEQ ID NO: 3459 - protein, 10 aa, Homo sapiens
SHNEEFGRTV

SEQ ID NO: 3460 - protein, 10 aa, Homo sapiens
YSHDDPEFRE

SEQ ID NO: 3461 - protein, 10 aa, Homo sapiens
RPLTVVAVAN

SEQ ID NO: 3462 - protein, 10 aa, Homo sapiens
LDPRPLTVVA

SEQ ID NO: 3463 - protein, 10 aa, Homo sapiens
ADGAFLDPRP

SEQ ID NO: 3464 - protein, 10 aa, Homo sapiens
VALLVRGSAD

SEQ ID NO: 3465 - protein, 10 aa, Homo sapiens
RSRQVLEGHV

SEQ ID NO: 3466 - protein, 10 aa, Homo sapiens
RQPRSRQVLE

SEQ ID NO: 3467 - protein, 10 aa, Homo sapiens
QRRAAHSMMR

SEQ ID NO: 3468 - protein, 10 aa, Homo sapiens
QQGSAFADRP

SEQ ID NO: 3469 - protein, 10 aa, Homo sapiens
HQALVQQGSA

SEQ ID NO: 3470 - protein, 10 aa, Homo sapiens
IHQALVQQGS

SEQ ID NO: 3471 - protein, 10 aa, Homo sapiens
IRLGSCPIVV

SEQ ID NO: 3472 - protein, 10 aa, Homo sapiens
FQIRLGSCPI

SEQ ID NO: 3473 - protein, 10 aa, Homo sapiens
AHLSFARLAR

SEQ ID NO: 3474 - protein, 10 aa, Homo sapiens
GQAAHLSFAR

SEQ ID NO: 3475 - protein, 10 aa, Homo sapiens
AAVGQAAHLS

SEQ ID NO: 3476 - protein, 10 aa, Homo sapiens
WPLIGNAAAV

SEQ ID NO: 3477 - protein, 10 aa, Homo sapiens
RQLRSAPPGP

SEQ ID NO: 3478 - protein, 10 aa, Homo sapiens
RRRQLRSAPP

SEQ ID NO: 3479 - protein, 10 aa, Homo sapiens
QRRRQLRSAP

SEQ ID NO: 3480 - protein, 10 aa, Homo sapiens
VGQRLLRQRR

SEQ ID NO: 3481 - protein, 10 aa, Homo sapiens
LNPLSIQQTT

SEQ ID NO: 3482 - protein, 10 aa, Homo sapiens
NDPWPLNPLS

SEQ ID NO: 3483 - protein, 10 aa, Homo sapiens
SPNDPWPLNP

SEQ ID NO: 3484 - protein, 10 aa, Homo sapiens
LSPNDPWPLN

SEQ ID NO: 3485 - protein, 10 aa, Homo sapiens
TSLSPNDPWP

SEQ ID NO: 3486 - protein, 10 aa, Homo sapiens
QNLQAKETCQ

SEQ ID NO: 3487 - protein, 10 aa, Homo sapiens
LDSAVQNLQA

SEQ ID NO: 3488 - protein, 10 aa, Homo sapiens
SMELLDSAVQ

SEQ ID NO: 3489 - protein, 10 aa, Homo sapiens
HQCDFRANPN

SEQ ID NO: 3490 - protein, 10 aa, Homo sapiens
RRCIGEELSK

SEQ ID NO: 3491 - protein, 10 aa, Homo sapiens
KWPNPENFDP

SEQ ID NO: 3492 - protein, 10 aa, Homo sapiens
HDPLKWPNPE

SEQ ID NO: 3493 - protein, 10 aa, Homo sapiens
VNHDPLKWPN

SEQ ID NO: 3494 - protein, 10 aa, Homo sapiens
WSVNHDPLKW

SEQ ID NO: 3495 - protein, 10 aa, Homo sapiens
QWSVNHDPLK

SEQ ID NO: 3496 - protein, 10 aa, Homo sapiens
VPVTIPHATT

SEQ ID NO: 3497 - protein, 10 aa, Homo sapiens
QDTLSTALQW

SEQ ID NO: 3498 - protein, 10 aa, Homo sapiens
VPATITDIFG

SEQ ID NO: 3499 - protein, 10 aa, Homo sapiens
GGGARLDLEN

SEQ ID NO: 3500 - protein, 10 aa, Homo sapiens
SAEKKAAGDS

SEQ ID NO: 3501 - protein, 10 aa, Homo sapiens
FEQLNRNFSN

SEQ ID NO: 3502 - protein, 10 aa, Homo sapiens
VRTVFREFEQ

SEQ ID NO: 3503 - protein, 10 aa, Homo sapiens
PWLQYFPNPV

SEQ ID NO: 3504 - protein, 10 aa, Homo sapiens
GRTVGAGSLV

SEQ ID NO: 3505 - protein, 10 aa, Homo sapiens
FRELLSHNEE

SEQ ID NO: 3506 - protein, 10 aa, Homo sapiens
LEGHVLSEAR

SEQ ID NO: 3507 - protein, 10 aa, Homo sapiens
RQVLEGHVLS

SEQ ID NO: 3508 - protein, 10 aa, Homo sapiens
MRNFFTRQPR

SEQ ID NO: 3509 - protein, 10 aa, Homo sapiens
MMRNFFTRQP

SEQ ID NO: 3510 - protein, 10 aa, Homo sapiens
SEHWKVQRRA

SEQ ID NO: 3511 - protein, 10 aa, Homo sapiens
GHYSEHWKVQ

SEQ ID NO: 3512 - protein, 10 aa, Homo sapiens
FGHYSEHWKV

SEQ ID NO: 3513 - protein, 10 aa, Homo sapiens
RSMAFGHYSE

SEQ ID NO: 3514 - protein, 10 aa, Homo sapiens
SGGRSMAFGH

SEQ ID NO: 3515 - protein, 10 aa, Homo sapiens
GERAIHQALV

SEQ ID NO: 3516 - protein, 10 aa, Homo sapiens
GDVFQIRLGS

SEQ ID NO: 3517 - protein, 10 aa, Homo sapiens
LARRYGDVFQ

SEQ ID NO: 3518 - protein, 10 aa, Homo sapiens
FARLARRYGD

SEQ ID NO: 3519 - protein, 10 aa, Homo sapiens
PGPFAWPLIG

SEQ ID NO: 3520 - protein, 10 aa, Homo sapiens
LRSAPPGPFA

SEQ ID NO: 3521 - protein, 10 aa, Homo sapiens
RRQLRSAPPG

SEQ ID NO: 3522 - protein, 10 aa, Homo sapiens
LRQRRRQLRS

SEQ ID NO: 3523 - protein, 10 aa, Homo sapiens
QRLLRQRRRQ

SEQ ID NO: 3524 - protein, 10 aa, Homo sapiens
GQRLLRQRRR

SEQ ID NO: 3525 - protein, 10 aa, Homo sapiens
WPLNPLSIQQ

SEQ ID NO: 3526 - protein, 10 aa, Homo sapiens
MGTSLSPNDP

SEQ ID NO: 3527 - protein, 9 aa, Homo sapiens
DPRPLTVVA

SEQ ID NO: 3528 - protein, 9 aa, Homo sapiens
PPGPFAWPL

SEQ ID NO: 3529 - protein, 9 aa, Homo sapiens
IPKDTVVFV

SEQ ID NO: 3530 - protein, 9 aa, Homo sapiens
QPNLPYVLA

SEQ ID NO: 3531 - protein, 9 aa, Homo sapiens
APRDMMDAF

SEQ ID NO: 3532 - protein, 9 aa, Homo sapiens
IPHATTANT

SEQ ID NO: 3533 - protein, 9 aa, Homo sapiens
FPNPVRTVF

SEQ ID NO: 3534 - protein, 9 aa, Homo sapiens
RPLTVVAVA

SEQ ID NO: 3535 - protein, 9 aa, Homo sapiens
KPKSFKVNV

SEQ ID NO: 3536 - protein, 9 aa, Homo sapiens
APPGPFAWP

SEQ ID NO: 3537 - protein, 9 aa, Homo sapiens
VPATITDIF

SEQ ID NO: 3538 - protein, 9 aa, Homo sapiens
RPAFASFRV

SEQ ID NO: 3539 - protein, 9 aa, Homo sapiens
LGSCPIVVL

SEQ ID NO: 3540 - protein, 9 aa, Homo sapiens
WPLIGNAAA

SEQ ID NO: 3541 - protein, 9 aa, Homo sapiens
ELSKMQLFL

SEQ ID NO: 3542 - protein, 9 aa, Homo sapiens
VPVTIPHAT

SEQ ID NO: 3543 - protein, 9 aa, Homo sapiens
RGSADGAFL

SEQ ID NO: 3544 - protein, 9 aa, Homo sapiens
HGGGARLDL

SEQ ID NO: 3545 - protein, 9 aa, Homo sapiens
NPLSIQQTT

SEQ ID NO: 3546 - protein, 9 aa, Homo sapiens
ENFDPARFL

SEQ ID NO: 3547 - protein, 9 aa, Homo sapiens
ATTANTSVL

SEQ ID NO: 3548 - protein, 9 aa, Homo sapiens
EARELVALL

SEQ ID NO: 3549 - protein, 9 aa, Homo sapiens
AAVGQAAHL

SEQ ID NO: 3550 - protein, 9 aa, Homo sapiens
RSAPPGPFA

SEQ ID NO: 3551 - protein, 9 aa, Homo sapiens
KSFKVNVTL

SEQ ID NO: 3552 - protein, 9 aa, Homo sapiens
KRRCIGEEL

SEQ ID NO: 3553 - protein, 9 aa, Homo sapiens
PCMGDQPNL

SEQ ID NO: 3554 - protein, 9 aa, Homo sapiens
DSHGGGARL

SEQ ID NO: 3555 - protein, 9 aa, Homo sapiens
SEARELVAL

SEQ ID NO: 3556 - protein, 9 aa, Homo sapiens
QPRSRQVLE

SEQ ID NO: 3557 - protein, 9 aa, Homo sapiens
GERAIHQAL

SEQ ID NO: 3558 - protein, 9 aa, Homo sapiens
AAHLSFARL

SEQ ID NO: 3559 - protein, 9 aa, Homo sapiens
NDPWPLNPL

SEQ ID NO: 3560 - protein, 9 aa, Homo sapiens
SPNDPWPLN

SEQ ID NO: 3561 - protein, 9 aa, Homo sapiens
AKMNFSYGL

SEQ ID NO: 3562 - protein, 9 aa, Homo sapiens
EPAKMNFSY

SEQ ID NO: 3563 - protein, 9 aa, Homo sapiens
NPNEPAKMN

SEQ ID NO: 3564 - protein, 9 aa, Homo sapiens
QWSVNHDPL

SEQ ID NO: 3565 - protein, 9 aa, Homo sapiens
YPDVQTRVQ

SEQ ID NO: 3566 - protein, 9 aa, Homo sapiens
FTRYPDVQT

SEQ ID NO: 3567 - protein, 9 aa, Homo sapiens
STALQWLLL

SEQ ID NO: 3568 - protein, 9 aa, Homo sapiens
SQDTLSTAL

SEQ ID NO: 3569 - protein, 9 aa, Homo sapiens
IFGASQDTL

SEQ ID NO: 3570 - protein, 9 aa, Homo sapiens
RPGAAPRDM

SEQ ID NO: 3571 - protein, 9 aa, Homo sapiens
HDDPEFREL

SEQ ID NO: 3572 - protein, 9 aa, Homo sapiens
AFLDPRPLT

SEQ ID NO: 3573 - protein, 9 aa, Homo sapiens
RQVLEGHVL

SEQ ID NO: 3574 - protein, 9 aa, Homo sapiens
RQPRSRQVL

SEQ ID NO: 3575 - protein, 9 aa, Homo sapiens
ADRPAFASF

SEQ ID NO: 3576 - protein, 9 aa, Homo sapiens
GPFAWPLIG

SEQ ID NO: 3577 - protein, 9 aa, Homo sapiens
LRSAPPGPF

SEQ ID NO: 3578 - protein, 9 aa, Homo sapiens
LLRQRRRQL

SEQ ID NO: 3579 - protein, 9 aa, Homo sapiens
ATVHVGQRL

SEQ ID NO: 3580 - protein, 9 aa, Homo sapiens
IQQTTLLLL

SEQ ID NO: 3581 - protein, 9 aa, Homo sapiens
SIQQTTLLL

SEQ ID NO: 3582 - protein, 9 aa, Homo sapiens
PLSIQQTTL

SEQ ID NO: 3583 - protein, 9 aa, Homo sapiens
WPLNPLSIQ

SEQ ID NO: 3584 - protein, 9 aa, Homo sapiens
LLDSAVQNL

SEQ ID NO: 3585 - protein, 9 aa, Homo sapiens
TLRESMELL

SEQ ID NO: 3586 - protein, 9 aa, Homo sapiens
KDGLINKDL

SEQ ID NO: 3587 - protein, 9 aa, Homo sapiens
ARFLDKDGL

SEQ ID NO: 3588 - protein, 9 aa, Homo sapiens
NPENFDPAR

SEQ ID NO: 3589 - protein, 9 aa, Homo sapiens
DPLKWPNPE

SEQ ID NO: 3590 - protein, 9 aa, Homo sapiens
RFSSFVPVT

SEQ ID NO: 3591 - protein, 9 aa, Homo sapiens
NLPYVLAFL

SEQ ID NO: 3592 - protein, 9 aa, Homo sapiens
TALQWLLLL

SEQ ID NO: 3593 - protein, 9 aa, Homo sapiens
TLSTALQWL

SEQ ID NO: 3594 - protein, 9 aa, Homo sapiens
RDMMDAFIL

SEQ ID NO: 3595 - protein, 9 aa, Homo sapiens
EEFGRTVGA

SEQ ID NO: 3596 - protein, 9 aa, Homo sapiens
DPEFRELLS

SEQ ID NO: 3597 - protein, 9 aa, Homo sapiens
AHSMMRNFF

SEQ ID NO: 3598 - protein, 9 aa, Homo sapiens
QQTTLLLLL

SEQ ID NO: 3599 - protein, 9 aa, Homo sapiens
LSIQQTTLL

SEQ ID NO: 3600 - protein, 9 aa, Homo sapiens
DPWPLNPLS

SEQ ID NO: 3601 - protein, 9 aa, Homo sapiens
FRANPNEPA

SEQ ID NO: 3602 - protein, 9 aa, Homo sapiens
SKMQLFLFI

SEQ ID NO: 3603 - protein, 9 aa, Homo sapiens
DPARFLDKD

SEQ ID NO: 3604 - protein, 9 aa, Homo sapiens
WPNPENFDP

SEQ ID NO: 3605 - protein, 9 aa, Homo sapiens
HIPKDTVVF

SEQ ID NO: 3606 - protein, 9 aa, Homo sapiens
PNLPYVLAF

SEQ ID NO: 3607 - protein, 9 aa, Homo sapiens
DQPNLPYVL

SEQ ID NO: 3608 - protein, 9 aa, Homo sapiens
LPCMGDQPN

SEQ ID NO: 3609 - protein, 9 aa, Homo sapiens
DQVVGRDRL

SEQ ID NO: 3610 - protein, 9 aa, Homo sapiens
VQTRVQAEL

SEQ ID NO: 3611 - protein, 9 aa, Homo sapiens
LSTALQWLL

SEQ ID NO: 3612 - protein, 9 aa, Homo sapiens
GASQDTLST

SEQ ID NO: 3613 - protein, 9 aa, Homo sapiens
RLDLENVPA

SEQ ID NO: 3614 - protein, 9 aa, Homo sapiens
ILSAEKKAA

SEQ ID NO: 3615 - protein, 9 aa, Homo sapiens
KFLRHCESL

SEQ ID NO: 3616 - protein, 9 aa, Homo sapiens
SNFILDKFL

SEQ ID NO: 3617 - protein, 9 aa, Homo sapiens
TVFREFEQL

SEQ ID NO: 3618 - protein, 9 aa, Homo sapiens
NPVRTVFRE

SEQ ID NO: 3619 - protein, 9 aa, Homo sapiens
MPWLQYFPN

SEQ ID NO: 3620 - protein, 9 aa, Homo sapiens
SLVDVMPWL

SEQ ID NO: 3621 - protein, 9 aa, Homo sapiens
VGAGSLVDV

SEQ ID NO: 3622 - protein, 9 aa, Homo sapiens
DDPEFRELL

SEQ ID NO: 3623 - protein, 9 aa, Homo sapiens
LDPRPLTVV

SEQ ID NO: 3624 - protein, 9 aa, Homo sapiens
GAFLDPRPL

SEQ ID NO: 3625 - protein, 9 aa, Homo sapiens
VVSGGRSMA

SEQ ID NO: 3626 - protein, 9 aa, Homo sapiens
AFADRPAFA

SEQ ID NO: 3627 - protein, 9 aa, Homo sapiens
YGDVFQIRL

SEQ ID NO: 3628 - protein, 9 aa, Homo sapiens
TLLLLLSVL

SEQ ID NO: 3629 - protein, 9 aa, Homo sapiens
LSPNDPWPL

SEQ ID NO: 3630 - protein, 9 aa, Homo sapiens
VTLRESMEL

SEQ ID NO: 3631 - protein, 9 aa, Homo sapiens
PKSFKVNVT

SEQ ID NO: 3632 - protein, 9 aa, Homo sapiens
QLFLFISIL

SEQ ID NO: 3633 - protein, 9 aa, Homo sapiens
GEELSKMQL

SEQ ID NO: 3634 - protein, 9 aa, Homo sapiens
KDLTSRVMI

SEQ ID NO: 3635 - protein, 9 aa, Homo sapiens
PVTIPHATT

SEQ ID NO: 3636 - protein, 9 aa, Homo sapiens
FSSFVPVTI

SEQ ID NO: 3637 - protein, 9 aa, Homo sapiens
MRFSSFVPV

SEQ ID NO: 3638 - protein, 9 aa, Homo sapiens
LPYVLAFLY

SEQ ID NO: 3639 - protein, 9 aa, Homo sapiens
ALQWLLLLF

SEQ ID NO: 3640 - protein, 9 aa, Homo sapiens
LENVPATIT

SEQ ID NO: 3641 - protein, 9 aa, Homo sapiens
AGDSHGGGA

SEQ ID NO: 3642 - protein, 9 aa, Homo sapiens
MMDAFILSA

SEQ ID NO: 3643 - protein, 9 aa, Homo sapiens
NRNFSNFIL

SEQ ID NO: 3644 - protein, 9 aa, Homo sapiens
YFPNPVRTV

SEQ ID NO: 3645 - protein, 9 aa, Homo sapiens
RTVGAGSLV

SEQ ID NO: 3646 - protein, 9 aa, Homo sapiens
GRTVGAGSL

SEQ ID NO: 3647 - protein, 9 aa, Homo sapiens
RYSHDDPEF

SEQ ID NO: 3648 - protein, 9 aa, Homo sapiens
ANVMSAVCF

SEQ ID NO: 3649 - protein, 9 aa, Homo sapiens
AVANVMSAV

SEQ ID NO: 3650 - protein, 9 aa, Homo sapiens
PRPLTVVAV

SEQ ID NO: 3651 - protein, 9 aa, Homo sapiens
FLDPRPLTV

SEQ ID NO: 3652 - protein, 9 aa, Homo sapiens
LVRGSADGA

SEQ ID NO: 3653 - protein, 9 aa, Homo sapiens
ARELVALLV

SEQ ID NO: 3654 - protein, 9 aa, Homo sapiens
LSEARELVA

SEQ ID NO: 3655 - protein, 9 aa, Homo sapiens
HVLSEAREL

SEQ ID NO: 3656 - protein, 9 aa, Homo sapiens
VSGGRSMAF

SEQ ID NO: 3657 - protein, 9 aa, Homo sapiens
SAFADRPAF

SEQ ID NO: 3658 - protein, 9 aa, Homo sapiens
ALVQQGSAF

SEQ ID NO: 3659 - protein, 9 aa, Homo sapiens
CPIVVLNGE

SEQ ID NO: 3660 - protein, 9 aa, Homo sapiens
IRLGSCPIV

SEQ ID NO: 3661 - protein, 9 aa, Homo sapiens
RRYGDVFQI

SEQ ID NO: 3662 - protein, 9 aa, Homo sapiens
LARRYGDVF

SEQ ID NO: 3663 - protein, 9 aa, Homo sapiens
NAAAVGQAA

SEQ ID NO: 3664 - protein, 9 aa, Homo sapiens
PLIGNAAAV

SEQ ID NO: 3665 - protein, 9 aa, Homo sapiens
AWPLIGNAA

SEQ ID NO: 3666 - protein, 9 aa, Homo sapiens
TVHVGQRLL

SEQ ID NO: 3667 - protein, 9 aa, Homo sapiens
LLLLSVLAT

SEQ ID NO: 3668 - protein, 9 aa, Homo sapiens
DSAVQNLQA

SEQ ID NO: 3669 - protein, 9 aa, Homo sapiens
MNFSYGLTI

SEQ ID NO: 3670 - protein, 9 aa, Homo sapiens
FSVGKRRCI

SEQ ID NO: 3671 - protein, 9 aa, Homo sapiens
YHIPKDTVV

SEQ ID NO: 3672 - protein, 9 aa, Homo sapiens
GYHIPKDTV

SEQ ID NO: 3673 - protein, 9 aa, Homo sapiens
NTSVLGYHI

SEQ ID NO: 3674 - protein, 9 aa, Homo sapiens
EAMRFSSFV

SEQ ID NO: 3675 - protein, 9 aa, Homo sapiens
PDVQTRVQA

SEQ ID NO: 3676 - protein, 9 aa, Homo sapiens
LQWLLLLFT

SEQ ID NO: 3677 - protein, 9 aa, Homo sapiens
LDLENVPAT

SEQ ID NO: 3678 - protein, 9 aa, Homo sapiens
PRDMMDAFI

SEQ ID NO: 3679 - protein, 9 aa, Homo sapiens
CESLRPGAA

SEQ ID NO: 3680 - protein, 9 aa, Homo sapiens
LNRNFSNFI

SEQ ID NO: 3681 - protein, 9 aa, Homo sapiens
PVRTVFREF

SEQ ID NO: 3682 - protein, 9 aa, Homo sapiens
QYFPNPVRT

SEQ ID NO: 3683 - protein, 9 aa, Homo sapiens
VLSEARELV

SEQ ID NO: 3684 - protein, 9 aa, Homo sapiens
PAFASFRVV

SEQ ID NO: 3685 - protein, 9 aa, Homo sapiens
ERAIHQALV

SEQ ID NO: 3686 - protein, 9 aa, Homo sapiens
RLGSCPIVV

SEQ ID NO: 3687 - protein, 9 aa, Homo sapiens
QIRLGSCPI

SEQ ID NO: 3688 - protein, 9 aa, Homo sapiens
GQAAHLSFA

SEQ ID NO: 3689 - protein, 9 aa, Homo sapiens
VGQAAHLSF

SEQ ID NO: 3690 - protein, 9 aa, Homo sapiens
GNAAAVGQA

SEQ ID NO: 3691 - protein, 9 aa, Homo sapiens
LSVLATVHV

SEQ ID NO: 3692 - protein, 9 aa, Homo sapiens
ESMELLDSA

SEQ ID NO: 3693 - protein, 9 aa, Homo sapiens
TSRVMIFSV

SEQ ID NO: 3694 - protein, 9 aa, Homo sapiens
INKDLTSRV

SEQ ID NO: 3695 - protein, 9 aa, Homo sapiens
PNPENFDPA

SEQ ID NO: 3696 - protein, 9 aa, Homo sapiens
VTIPHATTA

SEQ ID NO: 3697 - protein, 9 aa, Homo sapiens
YEAMRFSSF

SEQ ID NO: 3698 - protein, 9 aa, Homo sapiens
AFLYEAMRF

SEQ ID NO: 3699 - protein, 9 aa, Homo sapiens
GDQPNLPYV

SEQ ID NO: 3700 - protein, 9 aa, Homo sapiens
VQAELDQVV

SEQ ID NO: 3701 - protein, 9 aa, Homo sapiens
RVQAELDQV

SEQ ID NO: 3702 - protein, 9 aa, Homo sapiens
RYPDVQTRV

SEQ ID NO: 3703 - protein, 9 aa, Homo sapiens
ASQDTLSTA

SEQ ID NO: 3704 - protein, 9 aa, Homo sapiens
DIFGASQDT

SEQ ID NO: 3705 - protein, 9 aa, Homo sapiens
ATITDIFGA

SEQ ID NO: 3706 - protein, 9 aa, Homo sapiens
NVPATITDI

SEQ ID NO: 3707 - protein, 9 aa, Homo sapiens
GARLDLENV

SEQ ID NO: 3708 - protein, 9 aa, Homo sapiens
AAPRDMMDA

SEQ ID NO: 3709 - protein, 9 aa, Homo sapiens
HCESLRPGA

SEQ ID NO: 3710 - protein, 9 aa, Homo sapiens
DVMPWLQYF

SEQ ID NO: 3711 - protein, 9 aa, Homo sapiens
VAVANVMSA

SEQ ID NO: 3712 - protein, 9 aa, Homo sapiens
LTVVAVANV

SEQ ID NO: 3713 - protein, 9 aa, Homo sapiens
VRGSADGAF

SEQ ID NO: 3714 - protein, 9 aa, Homo sapiens
HSMMRNFFT

SEQ ID NO: 3715 - protein, 9 aa, Homo sapiens
AAHSMMRNF

SEQ ID NO: 3716 - protein, 9 aa, Homo sapiens
HWKVQRRAA

SEQ ID NO: 3717 - protein, 9 aa, Homo sapiens
EHWKVQRRA

SEQ ID NO: 3718 - protein, 9 aa, Homo sapiens
GSAFADRPA

SEQ ID NO: 3719 - protein, 9 aa, Homo sapiens
LVQQGSAFA

SEQ ID NO: 3720 - protein, 9 aa, Homo sapiens
IVVLNGERA

SEQ ID NO: 3721 - protein, 9 aa, Homo sapiens
RLARRYGDV

SEQ ID NO: 3722 - protein, 9 aa, Homo sapiens
AHLSFARLA

SEQ ID NO: 3723 - protein, 9 aa, Homo sapiens
QRRRQLRSA

SEQ ID NO: 3724 - protein, 9 aa, Homo sapiens
LLLLLSVLA

SEQ ID NO: 3725 - protein, 9 aa, Homo sapiens
TTLLLLLSV

SEQ ID NO: 3726 - protein, 9 aa, Homo sapiens
PWPLNPLSI

SEQ ID NO: 3727 - protein, 9 aa, Homo sapiens
SMELLDSAV

SEQ ID NO: 3728 - protein, 9 aa, Homo sapiens
TIKPKSFKV

SEQ ID NO: 3729 - protein, 9 aa, Homo sapiens
KMNFSYGLT

SEQ ID NO: 3730 - protein, 9 aa, Homo sapiens
PNEPAKMNF

SEQ ID NO: 3731 - protein, 9 aa, Homo sapiens
SILAHQCDF

SEQ ID NO: 3732 - protein, 9 aa, Homo sapiens
MQLFLFISI

SEQ ID NO: 3733 - protein, 9 aa, Homo sapiens
EELSKMQLF

SEQ ID NO: 3734 - protein, 9 aa, Homo sapiens
DLTSRVMIF

SEQ ID NO: 3735 - protein, 9 aa, Homo sapiens
RFLDKDGLI

SEQ ID NO: 3736 - protein, 9 aa, Homo sapiens
PENFDPARF

SEQ ID NO: 3737 - protein, 9 aa, Homo sapiens
LKWPNPENF

SEQ ID NO: 3738 - protein, 9 aa, Homo sapiens
HATTANTSV

SEQ ID NO: 3739 - protein, 9 aa, Homo sapiens
FVPVTIPHA

SEQ ID NO: 3740 - protein, 9 aa, Homo sapiens
YVLAFLYEA

SEQ ID NO: 3741 - protein, 9 aa, Homo sapiens
MGDQPNLPY

SEQ ID NO: 3742 - protein, 9 aa, Homo sapiens
LLFTRYPDV

SEQ ID NO: 3743 - protein, 9 aa, Homo sapiens
DLENVPATI

SEQ ID NO: 3744 - protein, 9 aa, Homo sapiens
ESLRPGAAP

SEQ ID NO: 3745 - protein, 9 aa, Homo sapiens
QLNRNFSNF

SEQ ID NO: 3746 - protein, 9 aa, Homo sapiens
EFEQLNRNF

SEQ ID NO: 3747 - protein, 9 aa, Homo sapiens
WLQYFPNPV

SEQ ID NO: 3748 - protein, 9 aa, Homo sapiens
HNEEFGRTV

SEQ ID NO: 3749 - protein, 9 aa, Homo sapiens
SHNEEFGRT

SEQ ID NO: 3750 - protein, 9 aa, Homo sapiens
ELLSHNEEF

SEQ ID NO: 3751 - protein, 9 aa, Homo sapiens
VALLVRGSA

SEQ ID NO: 3752 - protein, 9 aa, Homo sapiens
LEGHVLSEA

SEQ ID NO: 3753 - protein, 9 aa, Homo sapiens
TRQPRSRQV

SEQ ID NO: 3754 - protein, 9 aa, Homo sapiens
AFASFRVVS

SEQ ID NO: 3755 - protein, 9 aa, Homo sapiens
VVLNGERAI

SEQ ID NO: 3756 - protein, 9 aa, Homo sapiens
ARRYGDVFQ

SEQ ID NO: 3757 - protein, 9 aa, Homo sapiens
FAWPLIGNA

SEQ ID NO: 3758 - protein, 9 aa, Homo sapiens
PGPFAWPLI

SEQ ID NO: 3759 - protein, 9 aa, Homo sapiens
LLLSVLATV

SEQ ID NO: 3760 - protein, 9 aa, Homo sapiens
VQNLQAKET

SEQ ID NO: 3761 - protein, 9 aa, Homo sapiens
GLTIKPKSF

SEQ ID NO: 3762 - protein, 9 aa, Homo sapiens
LAHQCDFRA

SEQ ID NO: 3763 - protein, 9 aa, Homo sapiens
LFLFISILA

SEQ ID NO: 3764 - protein, 9 aa, Homo sapiens
LSKMQLFLF

SEQ ID NO: 3765 - protein, 9 aa, Homo sapiens
DGLINKDLT

SEQ ID NO: 3766 - protein, 9 aa, Homo sapiens
VVFVNQWSV

SEQ ID NO: 3767 - protein, 9 aa, Homo sapiens
LGYHIPKDT

SEQ ID NO: 3768 - protein, 9 aa, Homo sapiens
RDRLPCMGD

SEQ ID NO: 3769 - protein, 9 aa, Homo sapiens
FILSAEKKA

SEQ ID NO: 3770 - protein, 9 aa, Homo sapiens
PGAAPRDMM

SEQ ID NO: 3771 - protein, 9 aa, Homo sapiens
FSNFILDKF

SEQ ID NO: 3772 - protein, 9 aa, Homo sapiens
AGSLVDVMP

SEQ ID NO: 3773 - protein, 9 aa, Homo sapiens
SADGAFLDP

SEQ ID NO: 3774 - protein, 9 aa, Homo sapiens
SRQVLEGHV

SEQ ID NO: 3775 - protein, 9 aa, Homo sapiens
FTRQPRSRQ

SEQ ID NO: 3776 - protein, 9 aa, Homo sapiens
GHYSEHWKV

SEQ ID NO: 3777 - protein, 9 aa, Homo sapiens
QALVQQGSA

SEQ ID NO: 3778 - protein, 9 aa, Homo sapiens
NGERAIHQA

SEQ ID NO: 3779 - protein, 9 aa, Homo sapiens
HLSFARLAR

SEQ ID NO: 3780 - protein, 9 aa, Homo sapiens
LNPLSIQQT

SEQ ID NO: 3781 - protein, 9 aa, Homo sapiens
RESMELLDS

SEQ ID NO: 3782 - protein, 9 aa, Homo sapiens
LTIKPKSFK

SEQ ID NO: 3783 - protein, 9 aa, Homo sapiens
RCIGEELSK

SEQ ID NO: 3784 - protein, 9 aa, Homo sapiens
FLDKDGLIN

SEQ ID NO: 3785 - protein, 9 aa, Homo sapiens
KWPNPENFD

SEQ ID NO: 3786 - protein, 9 aa, Homo sapiens
SSFVPVTIP

SEQ ID NO: 3787 - protein, 9 aa, Homo sapiens
AMRFSSFVP

SEQ ID NO: 3788 - protein, 9 aa, Homo sapiens
VVGRDRLPC

SEQ ID NO: 3789 - protein, 9 aa, Homo sapiens
AELDQVVGR

SEQ ID NO: 3790 - protein, 9 aa, Homo sapiens
SLRPGAAPR

SEQ ID NO: 3791 - protein, 9 aa, Homo sapiens
LQYFPNPVR

SEQ ID NO: 3792 - protein, 9 aa, Homo sapiens
VDVMPWLQY

SEQ ID NO: 3793 - protein, 9 aa, Homo sapiens
TVGAGSLVD

SEQ ID NO: 3794 - protein, 9 aa, Homo sapiens
ADGAFLDPR

SEQ ID NO: 3795 - protein, 9 aa, Homo sapiens
VLEGHVLSE

SEQ ID NO: 3796 - protein, 9 aa, Homo sapiens
PRSRQVLEG

SEQ ID NO: 3797 - protein, 9 aa, Homo sapiens
FASFRVVSG

SEQ ID NO: 3798 - protein, 9 aa, Homo sapiens
FADRPAFAS

SEQ ID NO: 3799 - protein, 9 aa, Homo sapiens
AAAVGQAAH

SEQ ID NO: 3800 - protein, 9 aa, Homo sapiens
RRRQLRSAP

SEQ ID NO: 3801 - protein, 9 aa, Homo sapiens
RQRRRQLRS

SEQ ID NO: 3802 - protein, 9 aa, Homo sapiens
VHVGQRLLR

SEQ ID NO: 3803 - protein, 9 aa, Homo sapiens
IKPKSFKVN

SEQ ID NO: 3804 - protein, 9 aa, Homo sapiens
RANPNEPAK

SEQ ID NO: 3805 - protein, 9 aa, Homo sapiens
AHQCDFRAN

SEQ ID NO: 3806 - protein, 9 aa, Homo sapiens
RVMIFSVGK

SEQ ID NO: 3807 - protein, 9 aa, Homo sapiens
FDPARFLDK

SEQ ID NO: 3808 - protein, 9 aa, Homo sapiens
PLKWPNPEN

SEQ ID NO: 3809 - protein, 9 aa, Homo sapiens
KDTVVFVNQ

SEQ ID NO: 3810 - protein, 9 aa, Homo sapiens
ITDIFGASQ

SEQ ID NO: 3811 - protein, 9 aa, Homo sapiens
GDSHGGGAR

SEQ ID NO: 3812 - protein, 9 aa, Homo sapiens
KAAGDSHGG

SEQ ID NO: 3813 - protein, 9 aa, Homo sapiens
NFSNFILDK

SEQ ID NO: 3814 - protein, 9 aa, Homo sapiens
PNPVRTVFR

SEQ ID NO: 3815 - protein, 9 aa, Homo sapiens
FGRTVGAGS

SEQ ID NO: 3816 - protein, 9 aa, Homo sapiens
EFGRTVGAG

SEQ ID NO: 3817 - protein, 9 aa, Homo sapiens
SHDDPEFRE

SEQ ID NO: 3818 - protein, 9 aa, Homo sapiens
ALLVRGSAD

SEQ ID NO: 3819 - protein, 9 aa, Homo sapiens
ELVALLVRG

SEQ ID NO: 3820 - protein, 9 aa, Homo sapiens
RELVALLVR

SEQ ID NO: 3821 - protein, 9 aa, Homo sapiens
MMRNFFTRQ

SEQ ID NO: 3822 - protein, 9 aa, Homo sapiens
RSMAFGHYS

SEQ ID NO: 3823 - protein, 9 aa, Homo sapiens
AIHQALVQQ

SEQ ID NO: 3824 - protein, 9 aa, Homo sapiens
RAIHQALVQ

SEQ ID NO: 3825 - protein, 9 aa, Homo sapiens
VLNGERAIH

SEQ ID NO: 3826 - protein, 9 aa, Homo sapiens
GSCPIVVLN

SEQ ID NO: 3827 - protein, 9 aa, Homo sapiens
ARLARRYGD

SEQ ID NO: 3828 - protein, 9 aa, Homo sapiens
IGNAAAVGQ

SEQ ID NO: 3829 - protein, 9 aa, Homo sapiens
PFAWPLIGN

SEQ ID NO: 3830 - protein, 9 aa, Homo sapiens
LLSVLATVH

SEQ ID NO: 3831 - protein, 9 aa, Homo sapiens
PNDPWPLNP

SEQ ID NO: 3832 - protein, 9 aa, Homo sapiens
SLSPNDPWP

SEQ ID NO: 3833 - protein, 9 aa, Homo sapiens
TSLSPNDPW

SEQ ID NO: 3834 - protein, 9 aa, Homo sapiens
AVQNLQAKE

SEQ ID NO: 3835 - protein, 9 aa, Homo sapiens
LDSAVQNLQ

SEQ ID NO: 3836 - protein, 9 aa, Homo sapiens
ELLDSAVQN

SEQ ID NO: 3837 - protein, 9 aa, Homo sapiens
FKVNVTLRE

SEQ ID NO: 3838 - protein, 9 aa, Homo sapiens
FSYGLTIKP

SEQ ID NO: 3839 - protein, 9 aa, Homo sapiens
NFSYGLTIK

SEQ ID NO: 3840 - protein, 9 aa, Homo sapiens
ANPNEPAKM

SEQ ID NO: 3841 - protein, 9 aa, Homo sapiens
DFRANPNEP

SEQ ID NO: 3842 - protein, 9 aa, Homo sapiens
ILAHQCDFR

SEQ ID NO: 3843 - protein, 9 aa, Homo sapiens
FLFISILAH

SEQ ID NO: 3844 - protein, 9 aa, Homo sapiens
SVGKRRCIG

SEQ ID NO: 3845 - protein, 9 aa, Homo sapiens
IFSVGKRRC

SEQ ID NO: 3846 - protein, 9 aa, Homo sapiens
LTSRVMIFS

SEQ ID NO: 3847 - protein, 9 aa, Homo sapiens
DKDGLINKD

SEQ ID NO: 3848 - protein, 9 aa, Homo sapiens
NFDPARFLD

SEQ ID NO: 3849 - protein, 9 aa, Homo sapiens
NHDPLKWPN

SEQ ID NO: 3850 - protein, 9 aa, Homo sapiens
VNHDPLKWP

SEQ ID NO: 3851 - protein, 9 aa, Homo sapiens
PKDTVVFVN

SEQ ID NO: 3852 - protein, 9 aa, Homo sapiens
SVLGYHIPK

SEQ ID NO: 3853 - protein, 9 aa, Homo sapiens
TANTSVLGY

SEQ ID NO: 3854 - protein, 9 aa, Homo sapiens
TTANTSVLG

SEQ ID NO: 3855 - protein, 9 aa, Homo sapiens
TIPHATTAN

SEQ ID NO: 3856 - protein, 9 aa, Homo sapiens
SFVPVTIPH

SEQ ID NO: 3857 - protein, 9 aa, Homo sapiens
PYVLAFLYE

SEQ ID NO: 3858 - protein, 9 aa, Homo sapiens
VGRDRLPCM

SEQ ID NO: 3859 - protein, 9 aa, Homo sapiens
ELDQVVGRD

SEQ ID NO: 3860 - protein, 9 aa, Homo sapiens
QAELDQVVG

SEQ ID NO: 3861 - protein, 9 aa, Homo sapiens
ENVPATITD

SEQ ID NO: 3862 - protein, 9 aa, Homo sapiens
ARLDLENVP

SEQ ID NO: 3863 - protein, 9 aa, Homo sapiens
GGARLDLEN

SEQ ID NO: 3864 - protein, 9 aa, Homo sapiens
SHGGGARLD

SEQ ID NO: 3865 - protein, 9 aa, Homo sapiens
AAGDSHGGG

SEQ ID NO: 3866 - protein, 9 aa, Homo sapiens
KKAAGDSHG

SEQ ID NO: 3867 - protein, 9 aa, Homo sapiens
EKKAAGDSH

SEQ ID NO: 3868 - protein, 9 aa, Homo sapiens
AEKKAAGDS

SEQ ID NO: 3869 - protein, 9 aa, Homo sapiens
LSAEKKAAG

SEQ ID NO: 3870 - protein, 9 aa, Homo sapiens
LRPGAAPRD

SEQ ID NO: 3871 - protein, 9 aa, Homo sapiens
ILDKFLRHC

SEQ ID NO: 3872 - protein, 9 aa, Homo sapiens
FILDKFLRH

SEQ ID NO: 3873 - protein, 9 aa, Homo sapiens
GAGSLVDVM

SEQ ID NO: 3874 - protein, 9 aa, Homo sapiens
NEEFGRTVG

SEQ ID NO: 3875 - protein, 9 aa, Homo sapiens
LLSHNEEFG

SEQ ID NO: 3876 - protein, 9 aa, Homo sapiens
EFRELLSHN

SEQ ID NO: 3877 - protein, 9 aa, Homo sapiens
VCFGCRYSH

SEQ ID NO: 3878 - protein, 9 aa, Homo sapiens
VMSAVCFGC

SEQ ID NO: 3879 - protein, 9 aa, Homo sapiens
NVMSAVCFG

SEQ ID NO: 3880 - protein, 9 aa, Homo sapiens
VVAVANVMS

SEQ ID NO: 3881 - protein, 9 aa, Homo sapiens
PLTVVAVAN

SEQ ID NO: 3882 - protein, 9 aa, Homo sapiens
RSRQVLEGH

SEQ ID NO: 3883 - protein, 9 aa, Homo sapiens
RNFFTRQPR

SEQ ID NO: 3884 - protein, 9 aa, Homo sapiens
RRAAHSMMR

SEQ ID NO: 3885 - protein, 9 aa, Homo sapiens
QRRAAHSMM

SEQ ID NO: 3886 - protein, 9 aa, Homo sapiens
WKVQRRAAH

SEQ ID NO: 3887 - protein, 9 aa, Homo sapiens
HYSEHWKVQ

SEQ ID NO: 3888 - protein, 9 aa, Homo sapiens
AFGHYSEHW

SEQ ID NO: 3889 - protein, 9 aa, Homo sapiens
GRSMAFGHY

SEQ ID NO: 3890 - protein, 9 aa, Homo sapiens
SGGRSMAFG

SEQ ID NO: 3891 - protein, 9 aa, Homo sapiens
ASFRVVSGG

SEQ ID NO: 3892 - protein, 9 aa, Homo sapiens
QGSAFADRP

SEQ ID NO: 3893 - protein, 9 aa, Homo sapiens
QQGSAFADR

SEQ ID NO: 3894 - protein, 9 aa, Homo sapiens
VQQGSAFAD

SEQ ID NO: 3895 - protein, 9 aa, Homo sapiens
IHQALVQQG

SEQ ID NO: 3896 - protein, 9 aa, Homo sapiens
SCPIVVLNG

SEQ ID NO: 3897 - protein, 9 aa, Homo sapiens
DVFQIRLGS

SEQ ID NO: 3898 - protein, 9 aa, Homo sapiens
RYGDVFQIR

SEQ ID NO: 3899 - protein, 9 aa, Homo sapiens
FARLARRYG

SEQ ID NO: 3900 - protein, 9 aa, Homo sapiens
AVGQAAHLS

SEQ ID NO: 3901 - protein, 9 aa, Homo sapiens
LIGNAAAVG

SEQ ID NO: 3902 - protein, 9 aa, Homo sapiens
QLRSAPPGP

SEQ ID NO: 3903 - protein, 9 aa, Homo sapiens
RQLRSAPPG

SEQ ID NO: 3904 - protein, 9 aa, Homo sapiens
RRQLRSAPP

SEQ ID NO: 3905 - protein, 9 aa, Homo sapiens
GQRLLRQRR

SEQ ID NO: 3906 - protein, 9 aa, Homo sapiens
HVGQRLLRQ

SEQ ID NO: 3907 - protein, 9 aa, Homo sapiens
VLATVHVGQ

SEQ ID NO: 3908 - protein, 9 aa, Homo sapiens
SVLATVHVG

SEQ ID NO: 3909 - protein, 9 aa, Homo sapiens
NLQAKETCQ

SEQ ID NO: 3910 - protein, 9 aa, Homo sapiens
MELLDSAVQ

SEQ ID NO: 3911 - protein, 9 aa, Homo sapiens
LRESMELLD

SEQ ID NO: 3912 - protein, 9 aa, Homo sapiens
SFKVNVTLR

SEQ ID NO: 3913 - protein, 9 aa, Homo sapiens
SYGLTIKPK

SEQ ID NO: 3914 - protein, 9 aa, Homo sapiens
NEPAKMNFS

SEQ ID NO: 3915 - protein, 9 aa, Homo sapiens
QCDFRANPN

SEQ ID NO: 3916 - protein, 9 aa, Homo sapiens
HQCDFRANP

SEQ ID NO: 3917 - protein, 9 aa, Homo sapiens
FISILAHQC

SEQ ID NO: 3918 - protein, 9 aa, Homo sapiens
GKRRCIGEE

SEQ ID NO: 3919 - protein, 9 aa, Homo sapiens
SRVMIFSVG

SEQ ID NO: 3920 - protein, 9 aa, Homo sapiens
NKDLTSRVM

SEQ ID NO: 3921 - protein, 9 aa, Homo sapiens
LINKDLTSR

SEQ ID NO: 3922 - protein, 9 aa, Homo sapiens
GLINKDLTS

SEQ ID NO: 3923 - protein, 9 aa, Homo sapiens
PARFLDKDG

SEQ ID NO: 3924 - protein, 9 aa, Homo sapiens
SVNHDPLKW

SEQ ID NO: 3925 - protein, 9 aa, Homo sapiens
FVNQWSVNH

SEQ ID NO: 3926 - protein, 9 aa, Homo sapiens
VLGYHIPKD

SEQ ID NO: 3927 - protein, 9 aa, Homo sapiens
ANTSVLGYH

SEQ ID NO: 3928 - protein, 9 aa, Homo sapiens
LYEAMRFSS

SEQ ID NO: 3929 - protein, 9 aa, Homo sapiens
VLAFLYEAM

SEQ ID NO: 3930 - protein, 9 aa, Homo sapiens
RLPCMGDQP

SEQ ID NO: 3931 - protein, 9 aa, Homo sapiens
QVVGRDRLP

SEQ ID NO: 3932 - protein, 9 aa, Homo sapiens
TRVQAELDQ

SEQ ID NO: 3933 - protein, 9 aa, Homo sapiens
QTRVQAELD

SEQ ID NO: 3934 - protein, 9 aa, Homo sapiens
DVQTRVQAE

SEQ ID NO: 3935 - protein, 9 aa, Homo sapiens
TRYPDVQTR

SEQ ID NO: 3936 - protein, 9 aa, Homo sapiens
LLLFTRYPD

SEQ ID NO: 3937 - protein, 9 aa, Homo sapiens
WLLLLFTRY

SEQ ID NO: 3938 - protein, 9 aa, Homo sapiens
DTLSTALQW

SEQ ID NO: 3939 - protein, 9 aa, Homo sapiens
QDTLSTALQ

SEQ ID NO: 3940 - protein, 9 aa, Homo sapiens
FGASQDTLS

SEQ ID NO: 3941 - protein, 9 aa, Homo sapiens
TITDIFGAS

SEQ ID NO: 3942 - protein, 9 aa, Homo sapiens
GGGARLDLE

SEQ ID NO: 3943 - protein, 9 aa, Homo sapiens
SAEKKAAGD

SEQ ID NO: 3944 - protein, 9 aa, Homo sapiens
AFILSAEKK

SEQ ID NO: 3945 - protein, 9 aa, Homo sapiens
MDAFILSAE

SEQ ID NO: 3946 - protein, 9 aa, Homo sapiens
DMMDAFILS

SEQ ID NO: 3947 - protein, 9 aa, Homo sapiens
GAAPRDMMD

SEQ ID NO: 3948 - protein, 9 aa, Homo sapiens
RHCESLRPG

SEQ ID NO: 3949 - protein, 9 aa, Homo sapiens
LRHCESLRP

SEQ ID NO: 3950 - protein, 9 aa, Homo sapiens
FLRHCESLR

SEQ ID NO: 3951 - protein, 9 aa, Homo sapiens
RNFSNFILD

SEQ ID NO: 3952 - protein, 9 aa, Homo sapiens
FEQLNRNFS

SEQ ID NO: 3953 - protein, 9 aa, Homo sapiens
FREFEQLNR

SEQ ID NO: 3954 - protein, 9 aa, Homo sapiens
VFREFEQLN

SEQ ID NO: 3955 - protein, 9 aa, Homo sapiens
VRTVFREFE

SEQ ID NO: 3956 - protein, 9 aa, Homo sapiens
PWLQYFPNP

SEQ ID NO: 3957 - protein, 9 aa, Homo sapiens
GSLVDVMPW

SEQ ID NO: 3958 - protein, 9 aa, Homo sapiens
PEFRELLSH

SEQ ID NO: 3959 - protein, 9 aa, Homo sapiens
GCRYSHDDP

SEQ ID NO: 3960 - protein, 9 aa, Homo sapiens
AVCFGCRYS

SEQ ID NO: 3961 - protein, 9 aa, Homo sapiens
MSAVCFGCR

SEQ ID NO: 3962 - protein, 9 aa, Homo sapiens
VANVMSAVC

SEQ ID NO: 3963 - protein, 9 aa, Homo sapiens
TVVAVANVM

SEQ ID NO: 3964 - protein, 9 aa, Homo sapiens
DGAFLDPRP

SEQ ID NO: 3965 - protein, 9 aa, Homo sapiens
LVALLVRGS

SEQ ID NO: 3966 - protein, 9 aa, Homo sapiens
EGHVLSEAR

SEQ ID NO: 3967 - protein, 9 aa, Homo sapiens
QVLEGHVLS

SEQ ID NO: 3968 - protein, 9 aa, Homo sapiens
SMMRNFFTR

SEQ ID NO: 3969 - protein, 9 aa, Homo sapiens
RAAHSMMRN

SEQ ID NO: 3970 - protein, 9 aa, Homo sapiens
VQRRAAHSM

SEQ ID NO: 3971 - protein, 9 aa, Homo sapiens
KVQRRAAHS

SEQ ID NO: 3972 - protein, 9 aa, Homo sapiens
YSEHWKVQR

SEQ ID NO: 3973 - protein, 9 aa, Homo sapiens
MAFGHYSEH

SEQ ID NO: 3974 - protein, 9 aa, Homo sapiens
GGRSMAFGH

SEQ ID NO: 3975 - protein, 9 aa, Homo sapiens
RVVSGGRSM

SEQ ID NO: 3976 - protein, 9 aa, Homo sapiens
SFRVVSGGR

SEQ ID NO: 3977 - protein, 9 aa, Homo sapiens
DRPAFASFR

SEQ ID NO: 3978 - protein, 9 aa, Homo sapiens
LSFARLARR

SEQ ID NO: 3979 - protein, 9 aa, Homo sapiens
QAAHLSFAR

SEQ ID NO: 3980 - protein, 9 aa, Homo sapiens
SAPPGPFAW

SEQ ID NO: 3981 - protein, 9 aa, Homo sapiens
RLLRQRRRQ

SEQ ID NO: 3982 - protein, 9 aa, Homo sapiens
QTTLLLLLS

SEQ ID NO: 3983 - protein, 9 aa, Homo sapiens
GTSLSPNDP

SEQ ID NO: 3984 - protein, 9 aa, Homo sapiens
SAVQNLQAK

SEQ ID NO: 3985 - protein, 9 aa, Homo sapiens
VNVTLRESM

SEQ ID NO: 3986 - protein, 9 aa, Homo sapiens
KVNVTLRES

SEQ ID NO: 3987 - protein, 9 aa, Homo sapiens
YGLTIKPKS

SEQ ID NO: 3988 - protein, 9 aa, Homo sapiens
PAKMNFSYG

SEQ ID NO: 3989 - protein, 9 aa, Homo sapiens
CDFRANPNE

SEQ ID NO: 3990 - protein, 9 aa, Homo sapiens
ISILAHQCD

SEQ ID NO: 3991 - protein, 9 aa, Homo sapiens
LFISILAHQ

SEQ ID NO: 3992 - protein, 9 aa, Homo sapiens
KMQLFLFIS

SEQ ID NO: 3993 - protein, 9 aa, Homo sapiens
IGEELSKMQ

SEQ ID NO: 3994 - protein, 9 aa, Homo sapiens
CIGEELSKM

SEQ ID NO: 3995 - protein, 9 aa, Homo sapiens
RRCIGEELS

SEQ ID NO: 3996 - protein, 9 aa, Homo sapiens
MIFSVGKRR

SEQ ID NO: 3997 - protein, 9 aa, Homo sapiens
VMIFSVGKR

SEQ ID NO: 3998 - protein, 9 aa, Homo sapiens
HDPLKWPNP

SEQ ID NO: 3999 - protein, 9 aa, Homo sapiens
WSVNHDPLK

SEQ ID NO: 4000 - protein, 9 aa, Homo sapiens
VNQWSVNHD

SEQ ID NO: 4001 - protein, 9 aa, Homo sapiens
VFVNQWSVN

SEQ ID NO: 4002 - protein, 9 aa, Homo sapiens
DTVVFVNQW

SEQ ID NO: 4003 - protein, 9 aa, Homo sapiens
PHATTANTS

SEQ ID NO: 4004 - protein, 9 aa, Homo sapiens
FLYEAMRFS

SEQ ID NO: 4005 - protein, 9 aa, Homo sapiens
LAFLYEAMR

SEQ ID NO: 4006 - protein, 9 aa, Homo sapiens
CMGDQPNLP

SEQ ID NO: 4007 - protein, 9 aa, Homo sapiens
DRLPCMGDQ

SEQ ID NO: 4008 - protein, 9 aa, Homo sapiens
GRDRLPCMG

SEQ ID NO: 4009 - protein, 9 aa, Homo sapiens
LDQVVGRDR

SEQ ID NO: 4010 - protein, 9 aa, Homo sapiens
LFTRYPDVQ

SEQ ID NO: 4011 - protein, 9 aa, Homo sapiens
LLLLFTRYP

SEQ ID NO: 4012 - protein, 9 aa, Homo sapiens
PATITDIFG

SEQ ID NO: 4013 - protein, 9 aa, Homo sapiens
DAFILSAEK

SEQ ID NO: 4014 - protein, 9 aa, Homo sapiens
LDKFLRHCE

SEQ ID NO: 4015 - protein, 9 aa, Homo sapiens
EQLNRNFSN

SEQ ID NO: 4016 - protein, 9 aa, Homo sapiens
REFEQLNRN

SEQ ID NO: 4017 - protein, 9 aa, Homo sapiens
RTVFREFEQ

SEQ ID NO: 4018 - protein, 9 aa, Homo sapiens
VMPWLQYFP

SEQ ID NO: 4019 - protein, 9 aa, Homo sapiens
LVDVMPWLQ

SEQ ID NO: 4020 - protein, 9 aa, Homo sapiens
RELLSHNEE

SEQ ID NO: 4021 - protein, 9 aa, Homo sapiens
YSHDDPEFR

SEQ ID NO: 4022 - protein, 9 aa, Homo sapiens
CRYSHDDPE

SEQ ID NO: 4023 - protein, 9 aa, Homo sapiens
CFGCRYSHD

SEQ ID NO: 4024 - protein, 9 aa, Homo sapiens
SAVCFGCRY

SEQ ID NO: 4025 - protein, 9 aa, Homo sapiens
GSADGAFLD

SEQ ID NO: 4026 - protein, 9 aa, Homo sapiens
LLVRGSADG

SEQ ID NO: 4027 - protein, 9 aa, Homo sapiens
GHVLSEARE

SEQ ID NO: 4028 - protein, 9 aa, Homo sapiens
NFFTRQPRS

SEQ ID NO: 4029 - protein, 9 aa, Homo sapiens
MRNFFTRQP

SEQ ID NO: 4030 - protein, 9 aa, Homo sapiens
SEHWKVQRR

SEQ ID NO: 4031 - protein, 9 aa, Homo sapiens
SMAFGHYSE

SEQ ID NO: 4032 - protein, 9 aa, Homo sapiens
FRVVSGGRS

SEQ ID NO: 4033 - protein, 9 aa, Homo sapiens
HQALVQQGS

SEQ ID NO: 4034 - protein, 9 aa, Homo sapiens
LNGERAIHQ

SEQ ID NO: 4035 - protein, 9 aa, Homo sapiens
FQIRLGSCP

SEQ ID NO: 4036 - protein, 9 aa, Homo sapiens
SFARLARRY

SEQ ID NO: 4037 - protein, 9 aa, Homo sapiens
LRQRRRQLR

SEQ ID NO: 4038 - protein, 9 aa, Homo sapiens
LATVHVGQR

SEQ ID NO: 4039 - protein, 9 aa, Homo sapiens
PLNPLSIQQ

SEQ ID NO: 4040 - protein, 9 aa, Homo sapiens
MGTSLSPND

SEQ ID NO: 4041 - protein, 10 aa, Homo sapiens
APPGPFAWPL

SEQ ID NO: 4042 - protein, 10 aa, Homo sapiens
DPRPLTVVAV

SEQ ID NO: 4043 - protein, 10 aa, Homo sapiens
APRDMMDAFI

SEQ ID NO: 4044 - protein, 10 aa, Homo sapiens
LPCMGDQPNL

SEQ ID NO: 4045 - protein, 10 aa, Homo sapiens
NPLSIQQTTL

SEQ ID NO: 4046 - protein, 10 aa, Homo sapiens
QPNLPYVLAF

SEQ ID NO: 4047 - protein, 10 aa, Homo sapiens
YPDVQTRVQA

SEQ ID NO: 4048 - protein, 10 aa, Homo sapiens
RPGAAPRDMM

SEQ ID NO: 4049 - protein, 10 aa, Homo sapiens
RPAFASFRVV

SEQ ID NO: 4050 - protein, 10 aa, Homo sapiens
KPKSFKVNVT

SEQ ID NO: 4051 - protein, 10 aa, Homo sapiens
WPNPENFDPA

SEQ ID NO: 4052 - protein, 10 aa, Homo sapiens
PPGPFAWPLI

SEQ ID NO: 4053 - protein, 10 aa, Homo sapiens
DPWPLNPLSI

SEQ ID NO: 4054 - protein, 10 aa, Homo sapiens
WPLIGNAAAV

SEQ ID NO: 4055 - protein, 10 aa, Homo sapiens
NPENFDPARF

SEQ ID NO: 4056 - protein, 10 aa, Homo sapiens
VPVTIPHATT

SEQ ID NO: 4057 - protein, 10 aa, Homo sapiens
NPVRTVFREF

SEQ ID NO: 4058 - protein, 10 aa, Homo sapiens
NPNEPAKMNF

SEQ ID NO: 4059 - protein, 10 aa, Homo sapiens
SHGGGARLDL

SEQ ID NO: 4060 - protein, 10 aa, Homo sapiens
FPNPVRTVFR

SEQ ID NO: 4061 - protein, 10 aa, Homo sapiens
QPRSRQVLEG

SEQ ID NO: 4062 - protein, 10 aa, Homo sapiens
RLGSCPIVVL

SEQ ID NO: 4063 - protein, 10 aa, Homo sapiens
PKSFKVNVTL

SEQ ID NO: 4064 - protein, 10 aa, Homo sapiens
EPAKMNFSYG

SEQ ID NO: 4065 - protein, 10 aa, Homo sapiens
EELSKMQLFL

SEQ ID NO: 4066 - protein, 10 aa, Homo sapiens
AMRFSSFVPV

SEQ ID NO: 4067 - protein, 10 aa, Homo sapiens
ASQDTLSTAL

SEQ ID NO: 4068 - protein, 10 aa, Homo sapiens
RPLTVVAVAN

SEQ ID NO: 4069 - protein, 10 aa, Homo sapiens
LSEARELVAL

SEQ ID NO: 4070 - protein, 10 aa, Homo sapiens
AAAVGQAAHL

SEQ ID NO: 4071 - protein, 10 aa, Homo sapiens
PLSIQQTTLL

SEQ ID NO: 4072 - protein, 10 aa, Homo sapiens
SLSPNDPWPL

SEQ ID NO: 4073 - protein, 10 aa, Homo sapiens
DKDGLINKDL

SEQ ID NO: 4074 - protein, 10 aa, Homo sapiens
IPKDTVVFVN

SEQ ID NO: 4075 - protein, 10 aa, Homo sapiens
LPYVLAFLYE

SEQ ID NO: 4076 - protein, 10 aa, Homo sapiens
PNLPYVLAFL

SEQ ID NO: 4077 - protein, 10 aa, Homo sapiens
STALQWLLLL

SEQ ID NO: 4078 - protein, 10 aa, Homo sapiens
LSTALQWLLL

SEQ ID NO: 4079 - protein, 10 aa, Homo sapiens
GDSHGGGARL

SEQ ID NO: 4080 - protein, 10 aa, Homo sapiens
HDDPEFRELL

SEQ ID NO: 4081 - protein, 10 aa, Homo sapiens
VRGSADGAFL

SEQ ID NO: 4082 - protein, 10 aa, Homo sapiens
SEARELVALL

SEQ ID NO: 4083 - protein, 10 aa, Homo sapiens
TRQPRSRQVL

SEQ ID NO: 4084 - protein, 10 aa, Homo sapiens
QAAHLSFARL

SEQ ID NO: 4085 - protein, 10 aa, Homo sapiens
IQQTTLLLLL

SEQ ID NO: 4086 - protein, 10 aa, Homo sapiens
LSIQQTTLLL

SEQ ID NO: 4087 - protein, 10 aa, Homo sapiens
PNDPWPLNPL

SEQ ID NO: 4088 - protein, 10 aa, Homo sapiens
ELLDSAVQNL

SEQ ID NO: 4089 - protein, 10 aa, Homo sapiens
GKRRCIGEEL

SEQ ID NO: 4090 - protein, 10 aa, Homo sapiens
PARFLDKDGL

SEQ ID NO: 4091 - protein, 10 aa, Homo sapiens
DPLKWPNPEN

SEQ ID NO: 4092 - protein, 10 aa, Homo sapiens
HATTANTSVL

SEQ ID NO: 4093 - protein, 10 aa, Homo sapiens
IPHATTANTS

SEQ ID NO: 4094 - protein, 10 aa, Homo sapiens
GDQPNLPYVL

SEQ ID NO: 4095 - protein, 10 aa, Homo sapiens
TLSTALQWLL

SEQ ID NO: 4096 - protein, 10 aa, Homo sapiens
DIFGASQDTL

SEQ ID NO: 4097 - protein, 10 aa, Homo sapiens
VPATITDIFG

SEQ ID NO: 4098 - protein, 10 aa, Homo sapiens
LNRNFSNFIL

SEQ ID NO: 4099 - protein, 10 aa, Homo sapiens
RTVFREFEQL

SEQ ID NO: 4100 - protein, 10 aa, Homo sapiens
MPWLQYFPNP

SEQ ID NO: 4101 - protein, 10 aa, Homo sapiens
FGRTVGAGSL

SEQ ID NO: 4102 - protein, 10 aa, Homo sapiens
DPEFRELLSH

SEQ ID NO: 4103 - protein, 10 aa, Homo sapiens
SHDDPEFREL

SEQ ID NO: 4104 - protein, 10 aa, Homo sapiens
DGAFLDPRPL

SEQ ID NO: 4105 - protein, 10 aa, Homo sapiens
RYGDVFQIRL

SEQ ID NO: 4106 - protein, 10 aa, Homo sapiens
RLLRQRRRQL

SEQ ID NO: 4107 - protein, 10 aa, Homo sapiens
ATVHVGQRLL

SEQ ID NO: 4108 - protein, 10 aa, Homo sapiens
SIQQTTLLLL

SEQ ID NO: 4109 - protein, 10 aa, Homo sapiens
SPNDPWPLNP

SEQ ID NO: 4110 - protein, 10 aa, Homo sapiens
LDSAVQNLQA

SEQ ID NO: 4111 - protein, 10 aa, Homo sapiens
IGEELSKMQL

SEQ ID NO: 4112 - protein, 10 aa, Homo sapiens
DPARFLDKDG

SEQ ID NO: 4113 - protein, 10 aa, Homo sapiens
PENFDPARFL

SEQ ID NO: 4114 - protein, 10 aa, Homo sapiens
NQWSVNHDPL

SEQ ID NO: 4115 - protein, 10 aa, Homo sapiens
HIPKDTVVFV

SEQ ID NO: 4116 - protein, 10 aa, Homo sapiens
YHIPKDTVVF

SEQ ID NO: 4117 - protein, 10 aa, Homo sapiens
RFSSFVPVTI

SEQ ID NO: 4118 - protein, 10 aa, Homo sapiens
LDQVVGRDRL

SEQ ID NO: 4119 - protein, 10 aa, Homo sapiens
DVQTRVQAEL

SEQ ID NO: 4120 - protein, 10 aa, Homo sapiens
ALQWLLLLFT

SEQ ID NO: 4121 - protein, 10 aa, Homo sapiens
RLDLENVPAT

SEQ ID NO: 4122 - protein, 10 aa, Homo sapiens
ARLDLENVPA

SEQ ID NO: 4123 - protein, 10 aa, Homo sapiens
PRDMMDAFIL

SEQ ID NO: 4124 - protein, 10 aa, Homo sapiens
FSNFILDKFL

SEQ ID NO: 4125 - protein, 10 aa, Homo sapiens
GSLVDVMPWL

SEQ ID NO: 4126 - protein, 10 aa, Homo sapiens
VGAGSLVDVM

SEQ ID NO: 4127 - protein, 10 aa, Homo sapiens
LVRGSADGAF

SEQ ID NO: 4128 - protein, 10 aa, Homo sapiens
EARELVALLV

SEQ ID NO: 4129 - protein, 10 aa, Homo sapiens
VLSEARELVA

SEQ ID NO: 4130 - protein, 10 aa, Homo sapiens
SRQVLEGHVL

SEQ ID NO: 4131 - protein, 10 aa, Homo sapiens
AHSMMRNFFT

SEQ ID NO: 4132 - protein, 10 aa, Homo sapiens
VVSGGRSMAF

SEQ ID NO: 4133 - protein, 10 aa, Homo sapiens
NGERAIHQAL

SEQ ID NO: 4134 - protein, 10 aa, Homo sapiens
ARRYGDVFQI

SEQ ID NO: 4135 - protein, 10 aa, Homo sapiens
AVGQAAHLSF

SEQ ID NO: 4136 - protein, 10 aa, Homo sapiens
GPFAWPLIGN

SEQ ID NO: 4137 - protein, 10 aa, Homo sapiens
LRSAPPGPFA

SEQ ID NO: 4138 - protein, 10 aa, Homo sapiens
LLSVLATVHV

SEQ ID NO: 4139 - protein, 10 aa, Homo sapiens
TTLLLLLSVL

SEQ ID NO: 4140 - protein, 10 aa, Homo sapiens
VTLRESMELL

SEQ ID NO: 4141 - protein, 10 aa, Homo sapiens
NVTLRESMEL

SEQ ID NO: 4142 - protein, 10 aa, Homo sapiens
IKPKSFKVNV

SEQ ID NO: 4143 - protein, 10 aa, Homo sapiens
PAKMNFSYGL

SEQ ID NO: 4144 - protein, 10 aa, Homo sapiens
DFRANPNEPA

SEQ ID NO: 4145 - protein, 10 aa, Homo sapiens
MQLFLFISIL

SEQ ID NO: 4146 - protein, 10 aa, Homo sapiens
LSKMQLFLFI

SEQ ID NO: 4147 - protein, 10 aa, Homo sapiens
ELSKMQLFLF

SEQ ID NO: 4148 - protein, 10 aa, Homo sapiens
IFSVGKRRCI

SEQ ID NO: 4149 - protein, 10 aa, Homo sapiens
NKDLTSRVMI

SEQ ID NO: 4150 - protein, 10 aa, Homo sapiens
DTLSTALQWL

SEQ ID NO: 4151 - protein, 10 aa, Homo sapiens
FGASQDTLST

SEQ ID NO: 4152 - protein, 10 aa, Homo sapiens
DKFLRHCESL

SEQ ID NO: 4153 - protein, 10 aa, Homo sapiens
TVGAGSLVDV

SEQ ID NO: 4154 - protein, 10 aa, Homo sapiens
LDPRPLTVVA

SEQ ID NO: 4155 - protein, 10 aa, Homo sapiens
FLDPRPLTVV

SEQ ID NO: 4156 - protein, 10 aa, Homo sapiens
AFLDPRPLTV

SEQ ID NO: 4157 - protein, 10 aa, Homo sapiens
GHVLSEAREL

SEQ ID NO: 4158 - protein, 10 aa, Homo sapiens
AAHSMMRNFF

SEQ ID NO: 4159 - protein, 10 aa, Homo sapiens
EHWKVQRRAA

SEQ ID NO: 4160 - protein, 10 aa, Homo sapiens
GSAFADRPAF

SEQ ID NO: 4161 - protein, 10 aa, Homo sapiens
QGSAFADRPA

SEQ ID NO: 4162 - protein, 10 aa, Homo sapiens
ALVQQGSAFA

SEQ ID NO: 4163 - protein, 10 aa, Homo sapiens
GERAIHQALV

SEQ ID NO: 4164 - protein, 10 aa, Homo sapiens
CPIVVLNGER

SEQ ID NO: 4165 - protein, 10 aa, Homo sapiens
IRLGSCPIVV

SEQ ID NO: 4166 - protein, 10 aa, Homo sapiens
AWPLIGNAAA

SEQ ID NO: 4167 - protein, 10 aa, Homo sapiens
LATVHVGQRL

SEQ ID NO: 4168 - protein, 10 aa, Homo sapiens
LLLLLSVLAT

SEQ ID NO: 4169 - protein, 10 aa, Homo sapiens
WPLNPLSIQQ

SEQ ID NO: 4170 - protein, 10 aa, Homo sapiens
ESMELLDSAV

SEQ ID NO: 4171 - protein, 10 aa, Homo sapiens
RESMELLDSA

SEQ ID NO: 4172 - protein, 10 aa, Homo sapiens
KMNFSYGLTI

SEQ ID NO: 4173 - protein, 10 aa, Homo sapiens
AKMNFSYGLT

SEQ ID NO: 4174 - protein, 10 aa, Homo sapiens
RANPNEPAKM

SEQ ID NO: 4175 - protein, 10 aa, Homo sapiens
RCIGEELSKM

SEQ ID NO: 4176 - protein, 10 aa, Homo sapiens
MRFSSFVPVT

SEQ ID NO: 4177 - protein, 10 aa, Homo sapiens
RVQAELDQVV

SEQ ID NO: 4178 - protein, 10 aa, Homo sapiens
ENVPATITDI

SEQ ID NO: 4179 - protein, 10 aa, Homo sapiens
AAGDSHGGGA

SEQ ID NO: 4180 - protein, 10 aa, Homo sapiens
DMMDAFILSA

SEQ ID NO: 4181 - protein, 10 aa, Homo sapiens
AAPRDMMDAF

SEQ ID NO: 4182 - protein, 10 aa, Homo sapiens
RHCESLRPGA

SEQ ID NO: 4183 - protein, 10 aa, Homo sapiens
YFPNPVRTVF

SEQ ID NO: 4184 - protein, 10 aa, Homo sapiens
NEEFGRTVGA

SEQ ID NO: 4185 - protein, 10 aa, Homo sapiens
PRPLTVVAVA

SEQ ID NO: 4186 - protein, 10 aa, Homo sapiens
RSRQVLEGHV

SEQ ID NO: 4187 - protein, 10 aa, Homo sapiens
FADRPAFASF

SEQ ID NO: 4188 - protein, 10 aa, Homo sapiens
SAFADRPAFA

SEQ ID NO: 4189 - protein, 10 aa, Homo sapiens
QIRLGSCPIV

SEQ ID NO: 4190 - protein, 10 aa, Homo sapiens
RLARRYGDVF

SEQ ID NO: 4191 - protein, 10 aa, Homo sapiens
ARLARRYGDV

SEQ ID NO: 4192 - protein, 10 aa, Homo sapiens
GNAAAVGQAA

SEQ ID NO: 4193 - protein, 10 aa, Homo sapiens
IGNAAAVGQA

SEQ ID NO: 4194 - protein, 10 aa, Homo sapiens
QLRSAPPGPF

SEQ ID NO: 4195 - protein, 10 aa, Homo sapiens
RQRRRQLRSA

SEQ ID NO: 4196 - protein, 10 aa, Homo sapiens
AVQNLQAKET

SEQ ID NO: 4197 - protein, 10 aa, Homo sapiens
KVNVTLRESM

SEQ ID NO: 4198 - protein, 10 aa, Homo sapiens
ILAHQCDFRA

SEQ ID NO: 4199 - protein, 10 aa, Homo sapiens
KMQLFLFISI

SEQ ID NO: 4200 - protein, 10 aa, Homo sapiens
LTSRVMIFSV

SEQ ID NO: 4201 - protein, 10 aa, Homo sapiens
KDLTSRVMIF

SEQ ID NO: 4202 - protein, 10 aa, Homo sapiens
INKDLTSRVM

SEQ ID NO: 4203 - protein, 10 aa, Homo sapiens
LINKDLTSRV

SEQ ID NO: 4204 - protein, 10 aa, Homo sapiens
KDGLINKDLT

SEQ ID NO: 4205 - protein, 10 aa, Homo sapiens
ARFLDKDGLI

SEQ ID NO: 4206 - protein, 10 aa, Homo sapiens
GYHIPKDTVV

SEQ ID NO: 4207 - protein, 10 aa, Homo sapiens
ANTSVLGYHI

SEQ ID NO: 4208 - protein, 10 aa, Homo sapiens
PHATTANTSV

SEQ ID NO: 4209 - protein, 10 aa, Homo sapiens
TIPHATTANT

SEQ ID NO: 4210 - protein, 10 aa, Homo sapiens
SFVPVTIPHA

SEQ ID NO: 4211 - protein, 10 aa, Homo sapiens
YEAMRFSSFV

SEQ ID NO: 4212 - protein, 10 aa, Homo sapiens
LYEAMRFSSF

SEQ ID NO: 4213 - protein, 10 aa, Homo sapiens
YVLAFLYEAM

SEQ ID NO: 4214 - protein, 10 aa, Homo sapiens
DQPNLPYVLA

SEQ ID NO: 4215 - protein, 10 aa, Homo sapiens
MGDQPNLPYV

SEQ ID NO: 4216 - protein, 10 aa, Homo sapiens
VVGRDRLPCM

SEQ ID NO: 4217 - protein, 10 aa, Homo sapiens
TRYPDVQTRV

SEQ ID NO: 4218 - protein, 10 aa, Homo sapiens
LFTRYPDVQT

SEQ ID NO: 4219 - protein, 10 aa, Homo sapiens
TALQWLLLLF

SEQ ID NO: 4220 - protein, 10 aa, Homo sapiens
GASQDTLSTA

SEQ ID NO: 4221 - protein, 10 aa, Homo sapiens
NVPATITDIF

SEQ ID NO: 4222 - protein, 10 aa, Homo sapiens
AFILSAEKKA

SEQ ID NO: 4223 - protein, 10 aa, Homo sapiens
GAAPRDMMDA

SEQ ID NO: 4224 - protein, 10 aa, Homo sapiens
LRPGAAPRDM

SEQ ID NO: 4225 - protein, 10 aa, Homo sapiens
NFSNFILDKF

SEQ ID NO: 4226 - protein, 10 aa, Homo sapiens
EQLNRNFSNF

SEQ ID NO: 4227 - protein, 10 aa, Homo sapiens
QYFPNPVRTV

SEQ ID NO: 4228 - protein, 10 aa, Homo sapiens
LQYFPNPVRT

SEQ ID NO: 4229 - protein, 10 aa, Homo sapiens
VANVMSAVCF

SEQ ID NO: 4230 - protein, 10 aa, Homo sapiens
VAVANVMSAV

SEQ ID NO: 4231 - protein, 10 aa, Homo sapiens
VVAVANVMSA

SEQ ID NO: 4232 - protein, 10 aa, Homo sapiens
PLTVVAVANV

SEQ ID NO: 4233 - protein, 10 aa, Homo sapiens
GAFLDPRPLT

SEQ ID NO: 4234 - protein, 10 aa, Homo sapiens
LVALLVRGSA

SEQ ID NO: 4235 - protein, 10 aa, Homo sapiens
VLEGHVLSEA

SEQ ID NO: 4236 - protein, 10 aa, Homo sapiens
FTRQPRSRQV

SEQ ID NO: 4237 - protein, 10 aa, Homo sapiens
RAAHSMMRNF

SEQ ID NO: 4238 - protein, 10 aa, Homo sapiens
VQRRAAHSMM

SEQ ID NO: 4239 - protein, 10 aa, Homo sapiens
RVVSGGRSMA

SEQ ID NO: 4240 - protein, 10 aa, Homo sapiens
IVVLNGERAI

SEQ ID NO: 4241 - protein, 10 aa, Homo sapiens
AAHLSFARLA

SEQ ID NO: 4242 - protein, 10 aa, Homo sapiens
VGQAAHLSFA

SEQ ID NO: 4243 - protein, 10 aa, Homo sapiens
FAWPLIGNAA

SEQ ID NO: 4244 - protein, 10 aa, Homo sapiens
TLLLLLSVLA

SEQ ID NO: 4245 - protein, 10 aa, Homo sapiens
QTTLLLLLSV

SEQ ID NO: 4246 - protein, 10 aa, Homo sapiens
LTIKPKSFKV

SEQ ID NO: 4247 - protein, 10 aa, Homo sapiens
ISILAHQCDF

SEQ ID NO: 4248 - protein, 10 aa, Homo sapiens
VLGYHIPKDT

SEQ ID NO: 4249 - protein, 10 aa, Homo sapiens
PVTIPHATTA

SEQ ID NO: 4250 - protein, 10 aa, Homo sapiens
FVPVTIPHAT

SEQ ID NO: 4251 - protein, 10 aa, Homo sapiens
LLLFTRYPDV

SEQ ID NO: 4252 - protein, 10 aa, Homo sapiens
DLENVPATIT

SEQ ID NO: 4253 - protein, 10 aa, Homo sapiens
LDLENVPATI

SEQ ID NO: 4254 - protein, 10 aa, Homo sapiens
GGARLDLENV

SEQ ID NO: 4255 - protein, 10 aa, Homo sapiens
FILSAEKKAA

SEQ ID NO: 4256 - protein, 10 aa, Homo sapiens
HCESLRPGAA

SEQ ID NO: 4257 - protein, 10 aa, Homo sapiens
QLNRNFSNFI

SEQ ID NO: 4258 - protein, 10 aa, Homo sapiens
REFEQLNRNF

SEQ ID NO: 4259 - protein, 10 aa, Homo sapiens
PWLQYFPNPV

SEQ ID NO: 4260 - protein, 10 aa, Homo sapiens
LSHNEEFGRT

SEQ ID NO: 4261 - protein, 10 aa, Homo sapiens
RELLSHNEEF

SEQ ID NO: 4262 - protein, 10 aa, Homo sapiens
CRYSHDDPEF

SEQ ID NO: 4263 - protein, 10 aa, Homo sapiens
LTVVAVANVM

SEQ ID NO: 4264 - protein, 10 aa, Homo sapiens
HVLSEARELV

SEQ ID NO: 4265 - protein, 10 aa, Homo sapiens
KVQRRAAHSM

SEQ ID NO: 4266 - protein, 10 aa, Homo sapiens
DRPAFASFRV

SEQ ID NO: 4267 - protein, 10 aa, Homo sapiens
QALVQQGSAF

SEQ ID NO: 4268 - protein, 10 aa, Homo sapiens
HQALVQQGSA

SEQ ID NO: 4269 - protein, 10 aa, Homo sapiens
LNGERAIHQA

SEQ ID NO: 4270 - protein, 10 aa, Homo sapiens
FQIRLGSCPI

SEQ ID NO: 4271 - protein, 10 aa, Homo sapiens
PFAWPLIGNA

SEQ ID NO: 4272 - protein, 10 aa, Homo sapiens
LLLLSVLATV

SEQ ID NO: 4273 - protein, 10 aa, Homo sapiens
PLNPLSIQQT

SEQ ID NO: 4274 - protein, 10 aa, Homo sapiens
YGLTIKPKSF

SEQ ID NO: 4275 - protein, 10 aa, Homo sapiens
QLFLFISILA

SEQ ID NO: 4276 - protein, 10 aa, Homo sapiens
GEELSKMQLF

SEQ ID NO: 4277 - protein, 10 aa, Homo sapiens
PLKWPNPENF

SEQ ID NO: 4278 - protein, 10 aa, Homo sapiens
TVVFVNQWSV

SEQ ID NO: 4279 - protein, 10 aa, Homo sapiens
LGYHIPKDTV

SEQ ID NO: 4280 - protein, 10 aa, Homo sapiens
LAFLYEAMRF

SEQ ID NO: 4281 - protein, 10 aa, Homo sapiens
PYVLAFLYEA

SEQ ID NO: 4282 - protein, 10 aa, Homo sapiens
QVVGRDRLPC

SEQ ID NO: 4283 - protein, 10 aa, Homo sapiens
TRVQAELDQV

SEQ ID NO: 4284 - protein, 10 aa, Homo sapiens
TDIFGASQDT

SEQ ID NO: 4285 - protein, 10 aa, Homo sapiens
PATITDIFGA

SEQ ID NO: 4286 - protein, 10 aa, Homo sapiens
ILSAEKKAAG

SEQ ID NO: 4287 - protein, 10 aa, Homo sapiens
VDVMPWLQYF

SEQ ID NO: 4288 - protein, 10 aa, Homo sapiens
AGSLVDVMPW

SEQ ID NO: 4289 - protein, 10 aa, Homo sapiens
RTVGAGSLVD

SEQ ID NO: 4290 - protein, 10 aa, Homo sapiens
GRTVGAGSLV

SEQ ID NO: 4291 - protein, 10 aa, Homo sapiens
SHNEEFGRTV

SEQ ID NO: 4292 - protein, 10 aa, Homo sapiens
LLVRGSADGA

SEQ ID NO: 4293 - protein, 10 aa, Homo sapiens
SEHWKVQRRA

SEQ ID NO: 4294 - protein, 10 aa, Homo sapiens
FGHYSEHWKV

SEQ ID NO: 4295 - protein, 10 aa, Homo sapiens
FRVVSGGRSM

SEQ ID NO: 4296 - protein, 10 aa, Homo sapiens
AFASFRVVSG

SEQ ID NO: 4297 - protein, 10 aa, Homo sapiens
ADRPAFASFR

SEQ ID NO: 4298 - protein, 10 aa, Homo sapiens
PIVVLNGERA

SEQ ID NO: 4299 - protein, 10 aa, Homo sapiens
AHLSFARLAR

SEQ ID NO: 4300 - protein, 10 aa, Homo sapiens
LNPLSIQQTT

SEQ ID NO: 4301 - protein, 10 aa, Homo sapiens
NFDPARFLDK

SEQ ID NO: 4302 - protein, 10 aa, Homo sapiens
ATTANTSVLG

SEQ ID NO: 4303 - protein, 10 aa, Homo sapiens
EEFGRTVGAG

SEQ ID NO: 4304 - protein, 10 aa, Homo sapiens
AVANVMSAVC

SEQ ID NO: 4305 - protein, 10 aa, Homo sapiens
ADGAFLDPRP

SEQ ID NO: 4306 - protein, 10 aa, Homo sapiens
ARELVALLVR

SEQ ID NO: 4307 - protein, 10 aa, Homo sapiens
VSGGRSMAFG

SEQ ID NO: 4308 - protein, 10 aa, Homo sapiens
PAFASFRVVS

SEQ ID NO: 4309 - protein, 10 aa, Homo sapiens
ERAIHQALVQ

SEQ ID NO: 4310 - protein, 10 aa, Homo sapiens
LGSCPIVVLN

SEQ ID NO: 4311 - protein, 10 aa, Homo sapiens
LARRYGDVFQ

SEQ ID NO: 4312 - protein, 10 aa, Homo sapiens
RRRQLRSAPP

SEQ ID NO: 4313 - protein, 10 aa, Homo sapiens
TLRESMELLD

SEQ ID NO: 4314 - protein, 10 aa, Homo sapiens
KSFKVNVTLR

SEQ ID NO: 4315 - protein, 10 aa, Homo sapiens
AHQCDFRANP

SEQ ID NO: 4316 - protein, 10 aa, Homo sapiens
TSRVMIFSVG

SEQ ID NO: 4317 - protein, 10 aa, Homo sapiens
PKDTVVFVNQ

SEQ ID NO: 4318 - protein, 10 aa, Homo sapiens
TTANTSVLGY

SEQ ID NO: 4319 - protein, 10 aa, Homo sapiens
VTIPHATTAN

SEQ ID NO: 4320 - protein, 10 aa, Homo sapiens
FSSFVPVTIP

SEQ ID NO: 4321 - protein, 10 aa, Homo sapiens
CMGDQPNLPY

SEQ ID NO: 4322 - protein, 10 aa, Homo sapiens
VQAELDQVVG

SEQ ID NO: 4323 - protein, 10 aa, Homo sapiens
QTRVQAELDQ

SEQ ID NO: 4324 - protein, 10 aa, Homo sapiens
IFGASQDTLS

SEQ ID NO: 4325 - protein, 10 aa, Homo sapiens
ATITDIFGAS

SEQ ID NO: 4326 - protein, 10 aa, Homo sapiens
GGGARLDLEN

SEQ ID NO: 4327 - protein, 10 aa, Homo sapiens
AGDSHGGGAR

SEQ ID NO: 4328 - protein, 10 aa, Homo sapiens
KAAGDSHGGG

SEQ ID NO: 4329 - protein, 10 aa, Homo sapiens
SLRPGAAPRD

SEQ ID NO: 4330 - protein, 10 aa, Homo sapiens
CESLRPGAAP

SEQ ID NO: 4331 - protein, 10 aa, Homo sapiens
FLRHCESLRP

SEQ ID NO: 4332 - protein, 10 aa, Homo sapiens
ILDKFLRHCE

SEQ ID NO: 4333 - protein, 10 aa, Homo sapiens
VFREFEQLNR

SEQ ID NO: 4334 - protein, 10 aa, Homo sapiens
PVRTVFREFE

SEQ ID NO: 4335 - protein, 10 aa, Homo sapiens
RYSHDDPEFR

SEQ ID NO: 4336 - protein, 10 aa, Homo sapiens
VMSAVCFGCR

SEQ ID NO: 4337 - protein, 10 aa, Homo sapiens
ANVMSAVCFG

SEQ ID NO: 4338 - protein, 10 aa, Homo sapiens
SADGAFLDPR

SEQ ID NO: 4339 - protein, 10 aa, Homo sapiens
GSADGAFLDP

SEQ ID NO: 4340 - protein, 10 aa, Homo sapiens
RGSADGAFLD

SEQ ID NO: 4341 - protein, 10 aa, Homo sapiens
HYSEHWKVQR

SEQ ID NO: 4342 - protein, 10 aa, Homo sapiens
AFADRPAFAS

SEQ ID NO: 4343 - protein, 10 aa, Homo sapiens
VQQGSAFADR

SEQ ID NO: 4344 - protein, 10 aa, Homo sapiens
GSCPIVVLNG

SEQ ID NO: 4345 - protein, 10 aa, Homo sapiens
RRYGDVFQIR

SEQ ID NO: 4346 - protein, 10 aa, Homo sapiens
AAVGQAAHLS

SEQ ID NO: 4347 - protein, 10 aa, Homo sapiens
NAAAVGQAAH

SEQ ID NO: 4348 - protein, 10 aa, Homo sapiens
PLIGNAAAVG

SEQ ID NO: 4349 - protein, 10 aa, Homo sapiens
RSAPPGPFAW

SEQ ID NO: 4350 - protein, 10 aa, Homo sapiens
QRRRQLRSAP

SEQ ID NO: 4351 - protein, 10 aa, Homo sapiens
VHVGQRLLRQ

SEQ ID NO: 4352 - protein, 10 aa, Homo sapiens
SFKVNVTLRE

SEQ ID NO: 4353 - protein, 10 aa, Homo sapiens
TIKPKSFKVN

SEQ ID NO: 4354 - protein, 10 aa, Homo sapiens
FSYGLTIKPK

SEQ ID NO: 4355 - protein, 10 aa, Homo sapiens
NFSYGLTIKP

SEQ ID NO: 4356 - protein, 10 aa, Homo sapiens
FRANPNEPAK

SEQ ID NO: 4357 - protein, 10 aa, Homo sapiens
LFLFISILAH

SEQ ID NO: 4358 - protein, 10 aa, Homo sapiens
RRCIGEELSK

SEQ ID NO: 4359 - protein, 10 aa, Homo sapiens
KRRCIGEELS

SEQ ID NO: 4360 - protein, 10 aa, Homo sapiens
FSVGKRRCIG

SEQ ID NO: 4361 - protein, 10 aa, Homo sapiens
RVMIFSVGKR

SEQ ID NO: 4362 - protein, 10 aa, Homo sapiens
RFLDKDGLIN

SEQ ID NO: 4363 - protein, 10 aa, Homo sapiens
NHDPLKWPNP

SEQ ID NO: 4364 - protein, 10 aa, Homo sapiens
QWSVNHDPLK

SEQ ID NO: 4365 - protein, 10 aa, Homo sapiens
SVLGYHIPKD

SEQ ID NO: 4366 - protein, 10 aa, Homo sapiens
EAMRFSSFVP

SEQ ID NO: 4367 - protein, 10 aa, Homo sapiens
AFLYEAMRFS

SEQ ID NO: 4368 - protein, 10 aa, Homo sapiens
PCMGDQPNLP

SEQ ID NO: 4369 - protein, 10 aa, Homo sapiens
RDRLPCMGDQ

SEQ ID NO: 4370 - protein, 10 aa, Homo sapiens
AELDQVVGRD

SEQ ID NO: 4371 - protein, 10 aa, Homo sapiens
QAELDQVVGR

SEQ ID NO: 4372 - protein, 10 aa, Homo sapiens
RYPDVQTRVQ

SEQ ID NO: 4373 - protein, 10 aa, Homo sapiens
FTRYPDVQTR

SEQ ID NO: 4374 - protein, 10 aa, Homo sapiens
SQDTLSTALQ

SEQ ID NO: 4375 - protein, 10 aa, Homo sapiens
GARLDLENVP

SEQ ID NO: 4376 - protein, 10 aa, Homo sapiens
HGGGARLDLE

SEQ ID NO: 4377 - protein, 10 aa, Homo sapiens
KKAAGDSHGG

SEQ ID NO: 4378 - protein, 10 aa, Homo sapiens
AEKKAAGDSH

SEQ ID NO: 4379 - protein, 10 aa, Homo sapiens
MMDAFILSAE

SEQ ID NO: 4380 - protein, 10 aa, Homo sapiens
RDMMDAFILS

SEQ ID NO: 4381 - protein, 10 aa, Homo sapiens
ESLRPGAAPR

SEQ ID NO: 4382 - protein, 10 aa, Homo sapiens
NFILDKFLRH

SEQ ID NO: 4383 - protein, 10 aa, Homo sapiens
RNFSNFILDK

SEQ ID NO: 4384 - protein, 10 aa, Homo sapiens
EFEQLNRNFS

SEQ ID NO: 4385 - protein, 10 aa, Homo sapiens
DVMPWLQYFP

SEQ ID NO: 4386 - protein, 10 aa, Homo sapiens
LVDVMPWLQY

SEQ ID NO: 4387 - protein, 10 aa, Homo sapiens
GAGSLVDVMP

SEQ ID NO: 4388 - protein, 10 aa, Homo sapiens
EFGRTVGAGS

SEQ ID NO: 4389 - protein, 10 aa, Homo sapiens
HNEEFGRTVG

SEQ ID NO: 4390 - protein, 10 aa, Homo sapiens
EFRELLSHNE

SEQ ID NO: 4391 - protein, 10 aa, Homo sapiens
GCRYSHDDPE

SEQ ID NO: 4392 - protein, 10 aa, Homo sapiens
AVCFGCRYSH

SEQ ID NO: 4393 - protein, 10 aa, Homo sapiens
TVVAVANVMS

SEQ ID NO: 4394 - protein, 10 aa, Homo sapiens
ALLVRGSADG

SEQ ID NO: 4395 - protein, 10 aa, Homo sapiens
ELVALLVRGS

SEQ ID NO: 4396 - protein, 10 aa, Homo sapiens
RELVALLVRG

SEQ ID NO: 4397 - protein, 10 aa, Homo sapiens
QVLEGHVLSE

SEQ ID NO: 4398 - protein, 10 aa, Homo sapiens
RQVLEGHVLS

SEQ ID NO: 4399 - protein, 10 aa, Homo sapiens
RQPRSRQVLE

SEQ ID NO: 4400 - protein, 10 aa, Homo sapiens
MMRNFFTRQP

SEQ ID NO: 4401 - protein, 10 aa, Homo sapiens
SMMRNFFTRQ

SEQ ID NO: 4402 - protein, 10 aa, Homo sapiens
RRAAHSMMRN

SEQ ID NO: 4403 - protein, 10 aa, Homo sapiens
QRRAAHSMMR

SEQ ID NO: 4404 - protein, 10 aa, Homo sapiens
HWKVQRRAAH

SEQ ID NO: 4405 - protein, 10 aa, Homo sapiens
AFGHYSEHWK

SEQ ID NO: 4406 - protein, 10 aa, Homo sapiens
RSMAFGHYSE

SEQ ID NO: 4407 - protein, 10 aa, Homo sapiens
GGRSMAFGHY

SEQ ID NO: 4408 - protein, 10 aa, Homo sapiens
FASFRVVSGG

SEQ ID NO: 4409 - protein, 10 aa, Homo sapiens
AIHQALVQQG

SEQ ID NO: 4410 - protein, 10 aa, Homo sapiens
RAIHQALVQQ

SEQ ID NO: 4411 - protein, 10 aa, Homo sapiens
GDVFQIRLGS

SEQ ID NO: 4412 - protein, 10 aa, Homo sapiens
FARLARRYGD

SEQ ID NO: 4413 - protein, 10 aa, Homo sapiens
HLSFARLARR

SEQ ID NO: 4414 - protein, 10 aa, Homo sapiens
GQAAHLSFAR

SEQ ID NO: 4415 - protein, 10 aa, Homo sapiens
LIGNAAAVGQ

SEQ ID NO: 4416 - protein, 10 aa, Homo sapiens
SAPPGPFAWP

SEQ ID NO: 4417 - protein, 10 aa, Homo sapiens
RRQLRSAPPG

SEQ ID NO: 4418 - protein, 10 aa, Homo sapiens
LLRQRRRQLR

SEQ ID NO: 4419 - protein, 10 aa, Homo sapiens
TVHVGQRLLR

SEQ ID NO: 4420 - protein, 10 aa, Homo sapiens
SVLATVHVGQ

SEQ ID NO: 4421 - protein, 10 aa, Homo sapiens
GTSLSPNDPW

SEQ ID NO: 4422 - protein, 10 aa, Homo sapiens
DSAVQNLQAK

SEQ ID NO: 4423 - protein, 10 aa, Homo sapiens
MELLDSAVQN

SEQ ID NO: 4424 - protein, 10 aa, Homo sapiens
SMELLDSAVQ

SEQ ID NO: 4425 - protein, 10 aa, Homo sapiens
LRESMELLDS

SEQ ID NO: 4426 - protein, 10 aa, Homo sapiens
SYGLTIKPKS

SEQ ID NO: 4427 - protein, 10 aa, Homo sapiens
PNEPAKMNFS

SEQ ID NO: 4428 - protein, 10 aa, Homo sapiens
ANPNEPAKMN

SEQ ID NO: 4429 - protein, 10 aa, Homo sapiens
QCDFRANPNE

SEQ ID NO: 4430 - protein, 10 aa, Homo sapiens
LAHQCDFRAN

SEQ ID NO: 4431 - protein, 10 aa, Homo sapiens
SILAHQCDFR

SEQ ID NO: 4432 - protein, 10 aa, Homo sapiens
FISILAHQCD

SEQ ID NO: 4433 - protein, 10 aa, Homo sapiens
SVGKRRCIGE

SEQ ID NO: 4434 - protein, 10 aa, Homo sapiens
SRVMIFSVGK

SEQ ID NO: 4435 - protein, 10 aa, Homo sapiens
DGLINKDLTS

SEQ ID NO: 4436 - protein, 10 aa, Homo sapiens
FLDKDGLINK

SEQ ID NO: 4437 - protein, 10 aa, Homo sapiens
ENFDPARFLD

SEQ ID NO: 4438 - protein, 10 aa, Homo sapiens
PNPENFDPAR

SEQ ID NO: 4439 - protein, 10 aa, Homo sapiens
LKWPNPENFD

SEQ ID NO: 4440 - protein, 10 aa, Homo sapiens
WSVNHDPLKW

SEQ ID NO: 4441 - protein, 10 aa, Homo sapiens
VFVNQWSVNH

SEQ ID NO: 4442 - protein, 10 aa, Homo sapiens
KDTVVFVNQW

SEQ ID NO: 4443 - protein, 10 aa, Homo sapiens
NTSVLGYHIP

SEQ ID NO: 4444 - protein, 10 aa, Homo sapiens
SSFVPVTIPH

SEQ ID NO: 4445 - protein, 10 aa, Homo sapiens
VLAFLYEAMR

SEQ ID NO: 4446 - protein, 10 aa, Homo sapiens
RLPCMGDQPN

SEQ ID NO: 4447 - protein, 10 aa, Homo sapiens
VGRDRLPCMG

SEQ ID NO: 4448 - protein, 10 aa, Homo sapiens
ELDQVVGRDR

SEQ ID NO: 4449 - protein, 10 aa, Homo sapiens
PDVQTRVQAE

SEQ ID NO: 4450 - protein, 10 aa, Homo sapiens
LLLLFTRYPD

SEQ ID NO: 4451 - protein, 10 aa, Homo sapiens
QWLLLLFTRY

SEQ ID NO: 4452 - protein, 10 aa, Homo sapiens
QDTLSTALQW

SEQ ID NO: 4453 - protein, 10 aa, Homo sapiens
ITDIFGASQD

SEQ ID NO: 4454 - protein, 10 aa, Homo sapiens
DSHGGGARLD

SEQ ID NO: 4455 - protein, 10 aa, Homo sapiens
EKKAAGDSHG

SEQ ID NO: 4456 - protein, 10 aa, Homo sapiens
LSAEKKAAGD

SEQ ID NO: 4457 - protein, 10 aa, Homo sapiens
MDAFILSAEK

SEQ ID NO: 4458 - protein, 10 aa, Homo sapiens
PGAAPRDMMD

SEQ ID NO: 4459 - protein, 10 aa, Homo sapiens
WLQYFPNPVR

SEQ ID NO: 4460 - protein, 10 aa, Homo sapiens
LLSHNEEFGR

SEQ ID NO: 4461 - protein, 10 aa, Homo sapiens
ELLSHNEEFG

SEQ ID NO: 4462 - protein, 10 aa, Homo sapiens
DDPEFRELLS

SEQ ID NO: 4463 - protein, 10 aa, Homo sapiens
VCFGCRYSHD

SEQ ID NO: 4464 - protein, 10 aa, Homo sapiens
EGHVLSEARE

SEQ ID NO: 4465 - protein, 10 aa, Homo sapiens
LEGHVLSEAR

SEQ ID NO: 4466 - protein, 10 aa, Homo sapiens
PRSRQVLEGH

SEQ ID NO: 4467 - protein, 10 aa, Homo sapiens
RNFFTRQPRS

SEQ ID NO: 4468 - protein, 10 aa, Homo sapiens
MRNFFTRQPR

SEQ ID NO: 4469 - protein, 10 aa, Homo sapiens
HSMMRNFFTR

SEQ ID NO: 4470 - protein, 10 aa, Homo sapiens
MAFGHYSEHW

SEQ ID NO: 4471 - protein, 10 aa, Homo sapiens
GRSMAFGHYS

SEQ ID NO: 4472 - protein, 10 aa, Homo sapiens
SFRVVSGGRS

SEQ ID NO: 4473 - protein, 10 aa, Homo sapiens
ASFRVVSGGR

SEQ ID NO: 4474 - protein, 10 aa, Homo sapiens
IHQALVQQGS

SEQ ID NO: 4475 - protein, 10 aa, Homo sapiens
VLNGERAIHQ

SEQ ID NO: 4476 - protein, 10 aa, Homo sapiens
VVLNGERAIH

SEQ ID NO: 4477 - protein, 10 aa, Homo sapiens
SFARLARRYG

SEQ ID NO: 4478 - protein, 10 aa, Homo sapiens
PGPFAWPLIG

SEQ ID NO: 4479 - protein, 10 aa, Homo sapiens
RQLRSAPPGP

SEQ ID NO: 4480 - protein, 10 aa, Homo sapiens
LRQRRRQLRS

SEQ ID NO: 4481 - protein, 10 aa, Homo sapiens
GQRLLRQRRR

SEQ ID NO: 4482 - protein, 10 aa, Homo sapiens
VLATVHVGQR

SEQ ID NO: 4483 - protein, 10 aa, Homo sapiens
LSVLATVHVG

SEQ ID NO: 4484 - protein, 10 aa, Homo sapiens
LLLSVLATVH

SEQ ID NO: 4485 - protein, 10 aa, Homo sapiens
QQTTLLLLLS

SEQ ID NO: 4486 - protein, 10 aa, Homo sapiens
QNLQAKETCQ

SEQ ID NO: 4487 - protein, 10 aa, Homo sapiens
SAVQNLQAKE

SEQ ID NO: 4488 - protein, 10 aa, Homo sapiens
LLDSAVQNLQ

SEQ ID NO: 4489 - protein, 10 aa, Homo sapiens
GLTIKPKSFK

SEQ ID NO: 4490 - protein, 10 aa, Homo sapiens
MNFSYGLTIK

SEQ ID NO: 4491 - protein, 10 aa, Homo sapiens
NEPAKMNFSY

SEQ ID NO: 4492 - protein, 10 aa, Homo sapiens
HQCDFRANPN

SEQ ID NO: 4493 - protein, 10 aa, Homo sapiens
FLFISILAHQ

SEQ ID NO: 4494 - protein, 10 aa, Homo sapiens
SKMQLFLFIS

SEQ ID NO: 4495 - protein, 10 aa, Homo sapiens
CIGEELSKMQ

SEQ ID NO: 4496 - protein, 10 aa, Homo sapiens
DLTSRVMIFS

SEQ ID NO: 4497 - protein, 10 aa, Homo sapiens
GLINKDLTSR

SEQ ID NO: 4498 - protein, 10 aa, Homo sapiens
FDPARFLDKD

SEQ ID NO: 4499 - protein, 10 aa, Homo sapiens
KWPNPENFDP

SEQ ID NO: 4500 - protein, 10 aa, Homo sapiens
HDPLKWPNPE

SEQ ID NO: 4501 - protein, 10 aa, Homo sapiens
VNHDPLKWPN

SEQ ID NO: 4502 - protein, 10 aa, Homo sapiens
FVNQWSVNHD

SEQ ID NO: 4503 - protein, 10 aa, Homo sapiens
VVFVNQWSVN

SEQ ID NO: 4504 - protein, 10 aa, Homo sapiens
TSVLGYHIPK

SEQ ID NO: 4505 - protein, 10 aa, Homo sapiens
FLYEAMRFSS

SEQ ID NO: 4506 - protein, 10 aa, Homo sapiens
DRLPCMGDQP

SEQ ID NO: 4507 - protein, 10 aa, Homo sapiens
GRDRLPCMGD

SEQ ID NO: 4508 - protein, 10 aa, Homo sapiens
LLFTRYPDVQ

SEQ ID NO: 4509 - protein, 10 aa, Homo sapiens
WLLLLFTRYP

SEQ ID NO: 4510 - protein, 10 aa, Homo sapiens
TITDIFGASQ

SEQ ID NO: 4511 - protein, 10 aa, Homo sapiens
LENVPATITD

SEQ ID NO: 4512 - protein, 10 aa, Homo sapiens
SAEKKAAGDS

SEQ ID NO: 4513 - protein, 10 aa, Homo sapiens
LRHCESLRPG

SEQ ID NO: 4514 - protein, 10 aa, Homo sapiens
KFLRHCESLR

SEQ ID NO: 4515 - protein, 10 aa, Homo sapiens
NRNFSNFILD

SEQ ID NO: 4516 - protein, 10 aa, Homo sapiens
PNPVRTVFRE

SEQ ID NO: 4517 - protein, 10 aa, Homo sapiens
VMPWLQYFPN

SEQ ID NO: 4518 - protein, 10 aa, Homo sapiens
CFGCRYSHDD

SEQ ID NO: 4519 - protein, 10 aa, Homo sapiens
MSAVCFGCRY

SEQ ID NO: 4520 - protein, 10 aa, Homo sapiens
NVMSAVCFGC

SEQ ID NO: 4521 - protein, 10 aa, Homo sapiens
VALLVRGSAD

SEQ ID NO: 4522 - protein, 10 aa, Homo sapiens
FFTRQPRSRQ

SEQ ID NO: 4523 - protein, 10 aa, Homo sapiens
WKVQRRAAHS

SEQ ID NO: 4524 - protein, 10 aa, Homo sapiens
YSEHWKVQRR

SEQ ID NO: 4525 - protein, 10 aa, Homo sapiens
GHYSEHWKVQ

SEQ ID NO: 4526 - protein, 10 aa, Homo sapiens
SMAFGHYSEH

SEQ ID NO: 4527 - protein, 10 aa, Homo sapiens
SGGRSMAFGH

SEQ ID NO: 4528 - protein, 10 aa, Homo sapiens
QQGSAFADRP

SEQ ID NO: 4529 - protein, 10 aa, Homo sapiens
LVQQGSAFAD

SEQ ID NO: 4530 - protein, 10 aa, Homo sapiens
YGDVFQIRLG

SEQ ID NO: 4531 - protein, 10 aa, Homo sapiens
LSFARLARRY

SEQ ID NO: 4532 - protein, 10 aa, Homo sapiens
QRLLRQRRRQ

SEQ ID NO: 4533 - protein, 10 aa, Homo sapiens
VGQRLLRQRR

SEQ ID NO: 4534 - protein, 10 aa, Homo sapiens
HVGQRLLRQR

SEQ ID NO: 4535 - protein, 10 aa, Homo sapiens
NDPWPLNPLS

SEQ ID NO: 4536 - protein, 10 aa, Homo sapiens
LSPNDPWPLN

SEQ ID NO: 4537 - protein, 10 aa, Homo sapiens
TSLSPNDPWP

SEQ ID NO: 4538 - protein, 11 aa, Homo sapiens
HLABNNAMERS

SEQ ID NO: 4539 - protein, 9 aa, Homo sapiens
AHSMMRNFF

SEQ ID NO: 4540 - protein, 9 aa, Homo sapiens
LGSCPIVVL

SEQ ID NO: 4541 - protein, 9 aa, Homo sapiens
EHWKVQRRA

SEQ ID NO: 4542 - protein, 9 aa, Homo sapiens
ENFDPARFL

SEQ ID NO: 4543 - protein, 9 aa, Homo sapiens
YHIPKDTVV

SEQ ID NO: 4544 - protein, 9 aa, Homo sapiens
DQVVGRDRL

SEQ ID NO: 4545 - protein, 9 aa, Homo sapiens
HDDPEFREL

SEQ ID NO: 4546 - protein, 9 aa, Homo sapiens
TVHVGQRLL

SEQ ID NO: 4547 - protein, 9 aa, Homo sapiens
KSFKVNVTL

SEQ ID NO: 4548 - protein, 9 aa, Homo sapiens
SHGGGARLD

SEQ ID NO: 4549 - protein, 9 aa, Homo sapiens
DSHGGGARL

SEQ ID NO: 4550 - protein, 9 aa, Homo sapiens
SHDDPEFRE

SEQ ID NO: 4551 - protein, 9 aa, Homo sapiens
GAFLDPRPL

SEQ ID NO: 4552 - protein, 9 aa, Homo sapiens
SEARELVAL

SEQ ID NO: 4553 - protein, 9 aa, Homo sapiens
YGDVFQIRL

SEQ ID NO: 4554 - protein, 9 aa, Homo sapiens
LLRQRRRQL

SEQ ID NO: 4555 - protein, 9 aa, Homo sapiens
TLRESMELL

SEQ ID NO: 4556 - protein, 9 aa, Homo sapiens
AHQCDFRAN

SEQ ID NO: 4557 - protein, 9 aa, Homo sapiens
ELSKMQLFL

SEQ ID NO: 4558 - protein, 9 aa, Homo sapiens
GEELSKMQL

SEQ ID NO: 4559 - protein, 9 aa, Homo sapiens
NHDPLKWPN

SEQ ID NO: 4560 - protein, 9 aa, Homo sapiens
QWSVNHDPL

SEQ ID NO: 4561 - protein, 9 aa, Homo sapiens
ATTANTSVL

SEQ ID NO: 4562 - protein, 9 aa, Homo sapiens
DQPNLPYVL

SEQ ID NO: 4563 - protein, 9 aa, Homo sapiens
IFGASQDTL

SEQ ID NO: 4564 - protein, 9 aa, Homo sapiens
RHCESLRPG

SEQ ID NO: 4565 - protein, 9 aa, Homo sapiens
SLVDVMPWL

SEQ ID NO: 4566 - protein, 9 aa, Homo sapiens
GRTVGAGSL

SEQ ID NO: 4567 - protein, 9 aa, Homo sapiens
SHNEEFGRT

SEQ ID NO: 4568 - protein, 9 aa, Homo sapiens
EARELVALL

SEQ ID NO: 4569 - protein, 9 aa, Homo sapiens
HVLSEAREL

SEQ ID NO: 4570 - protein, 9 aa, Homo sapiens
GHVLSEARE

SEQ ID NO: 4571 - protein, 9 aa, Homo sapiens
RQPRSRQVL

SEQ ID NO: 4572 - protein, 9 aa, Homo sapiens
IHQALVQQG

SEQ ID NO: 4573 - protein, 9 aa, Homo sapiens
TLLLLLSVL

SEQ ID NO: 4574 - protein, 9 aa, Homo sapiens
PHATTANTS

SEQ ID NO: 4575 - protein, 9 aa, Homo sapiens
PCMGDQPNL

SEQ ID NO: 4576 - protein, 9 aa, Homo sapiens
TALQWLLLL

SEQ ID NO: 4577 - protein, 9 aa, Homo sapiens
TLSTALQWL

SEQ ID NO: 4578 - protein, 9 aa, Homo sapiens
HGGGARLDL

SEQ ID NO: 4579 - protein, 9 aa, Homo sapiens
DDPEFRELL

SEQ ID NO: 4580 - protein, 9 aa, Homo sapiens
RQVLEGHVL

SEQ ID NO: 4581 - protein, 9 aa, Homo sapiens
GERAIHQAL

SEQ ID NO: 4582 - protein, 9 aa, Homo sapiens
AHLSFARLA

SEQ ID NO: 4583 - protein, 9 aa, Homo sapiens
AAHLSFARL

SEQ ID NO: 4584 - protein, 9 aa, Homo sapiens
PPGPFAWPL

SEQ ID NO: 4585 - protein, 9 aa, Homo sapiens
VHVGQRLLR

SEQ ID NO: 4586 - protein, 9 aa, Homo sapiens
ATVHVGQRL

SEQ ID NO: 4587 - protein, 9 aa, Homo sapiens
IQQTTLLLL

SEQ ID NO: 4588 - protein, 9 aa, Homo sapiens
PLSIQQTTL

SEQ ID NO: 4589 - protein, 9 aa, Homo sapiens
LLDSAVQNL

SEQ ID NO: 4590 - protein, 9 aa, Homo sapiens
VTLRESMEL

SEQ ID NO: 4591 - protein, 9 aa, Homo sapiens
QLFLFISIL

SEQ ID NO: 4592 - protein, 9 aa, Homo sapiens
KRRCIGEEL

SEQ ID NO: 4593 - protein, 9 aa, Homo sapiens
ARFLDKDGL

SEQ ID NO: 4594 - protein, 9 aa, Homo sapiens
HIPKDTVVF

SEQ ID NO: 4595 - protein, 9 aa, Homo sapiens
VQTRVQAEL

SEQ ID NO: 4596 - protein, 9 aa, Homo sapiens
STALQWLLL

SEQ ID NO: 4597 - protein, 9 aa, Homo sapiens
SQDTLSTAL

SEQ ID NO: 4598 - protein, 9 aa, Homo sapiens
EFEQLNRNF

SEQ ID NO: 4599 - protein, 9 aa, Homo sapiens
TVFREFEQL

SEQ ID NO: 4600 - protein, 9 aa, Homo sapiens
FPNPVRTVF

SEQ ID NO: 4601 - protein, 9 aa, Homo sapiens
RGSADGAFL

SEQ ID NO: 4602 - protein, 9 aa, Homo sapiens
GHYSEHWKV

SEQ ID NO: 4603 - protein, 9 aa, Homo sapiens
AAVGQAAHL

SEQ ID NO: 4604 - protein, 9 aa, Homo sapiens
SIQQTTLLL

SEQ ID NO: 4605 - protein, 9 aa, Homo sapiens
LSIQQTTLL

SEQ ID NO: 4606 - protein, 9 aa, Homo sapiens
NDPWPLNPL

SEQ ID NO: 4607 - protein, 9 aa, Homo sapiens
LSPNDPWPL

SEQ ID NO: 4608 - protein, 9 aa, Homo sapiens
AKMNFSYGL

SEQ ID NO: 4609 - protein, 9 aa, Homo sapiens
PNEPAKMNF

SEQ ID NO: 4610 - protein, 9 aa, Homo sapiens
IFSVGKRRC

SEQ ID NO: 4611 - protein, 9 aa, Homo sapiens
NKDLTSRVM

SEQ ID NO: 4612 - protein, 9 aa, Homo sapiens
KDGLINKDL

SEQ ID NO: 4613 - protein, 9 aa, Homo sapiens
LKWPNPENF

SEQ ID NO: 4614 - protein, 9 aa, Homo sapiens
NLPYVLAFL

SEQ ID NO: 4615 - protein, 9 aa, Homo sapiens
PNLPYVLAF

SEQ ID NO: 4616 - protein, 9 aa, Homo sapiens
LSTALQWLL

SEQ ID NO: 4617 - protein, 9 aa, Homo sapiens
RDMMDAFIL

SEQ ID NO: 4618 - protein, 9 aa, Homo sapiens
KFLRHCESL

SEQ ID NO: 4619 - protein, 9 aa, Homo sapiens
SNFILDKFL

SEQ ID NO: 4620 - protein, 9 aa, Homo sapiens
NRNFSNFIL

SEQ ID NO: 4621 - protein, 9 aa, Homo sapiens
GAGSLVDVM

SEQ ID NO: 4622 - protein, 9 aa, Homo sapiens
QQTTLLLLL

SEQ ID NO: 4623 - protein, 9 aa, Homo sapiens
PENFDPARF

SEQ ID NO: 4624 - protein, 9 aa, Homo sapiens
APRDMMDAF

SEQ ID NO: 4625 - protein, 9 aa, Homo sapiens
PGAAPRDMM

SEQ ID NO: 4626 - protein, 9 aa, Homo sapiens
RPGAAPRDM

SEQ ID NO: 4627 - protein, 9 aa, Homo sapiens
PVRTVFREF

SEQ ID NO: 4628 - protein, 9 aa, Homo sapiens
RYSHDDPEF

SEQ ID NO: 4629 - protein, 9 aa, Homo sapiens
TVVAVANVM

SEQ ID NO: 4630 - protein, 9 aa, Homo sapiens
AAHSMMRNF

SEQ ID NO: 4631 - protein, 9 aa, Homo sapiens
RVVSGGRSM

SEQ ID NO: 4632 - protein, 9 aa, Homo sapiens
SAFADRPAF

SEQ ID NO: 4633 - protein, 9 aa, Homo sapiens
LRSAPPGPF

SEQ ID NO: 4634 - protein, 9 aa, Homo sapiens
GLTIKPKSF

SEQ ID NO: 4635 - protein, 9 aa, Homo sapiens
EELSKMQLF

SEQ ID NO: 4636 - protein, 9 aa, Homo sapiens
YEAMRFSSF

SEQ ID NO: 4637 - protein, 9 aa, Homo sapiens
AFLYEAMRF

SEQ ID NO: 4638 - protein, 9 aa, Homo sapiens
VLAFLYEAM

SEQ ID NO: 4639 - protein, 9 aa, Homo sapiens
VGRDRLPCM

SEQ ID NO: 4640 - protein, 9 aa, Homo sapiens
QYFPNPVRT

SEQ ID NO: 4641 - protein, 9 aa, Homo sapiens
DVMPWLQYF

SEQ ID NO: 4642 - protein, 9 aa, Homo sapiens
ELLSHNEEF

SEQ ID NO: 4643 - protein, 9 aa, Homo sapiens
ANVMSAVCF

SEQ ID NO: 4644 - protein, 9 aa, Homo sapiens
VSGGRSMAF

SEQ ID NO: 4645 - protein, 9 aa, Homo sapiens
ADRPAFASF

SEQ ID NO: 4646 - protein, 9 aa, Homo sapiens
ALVQQGSAF

SEQ ID NO: 4647 - protein, 9 aa, Homo sapiens
LARRYGDVF

SEQ ID NO: 4648 - protein, 9 aa, Homo sapiens
VNVTLRESM

SEQ ID NO: 4649 - protein, 9 aa, Homo sapiens
ANPNEPAKM

SEQ ID NO: 4650 - protein, 9 aa, Homo sapiens
CIGEELSKM

SEQ ID NO: 4651 - protein, 9 aa, Homo sapiens
DLTSRVMIF

SEQ ID NO: 4652 - protein, 9 aa, Homo sapiens
VPATITDIF

SEQ ID NO: 4653 - protein, 9 aa, Homo sapiens
QLNRNFSNF

SEQ ID NO: 4654 - protein, 9 aa, Homo sapiens
VRGSADGAF

SEQ ID NO: 4655 - protein, 9 aa, Homo sapiens
SILAHQCDF

SEQ ID NO: 4656 - protein, 9 aa, Homo sapiens
LSKMQLFLF

SEQ ID NO: 4657 - protein, 9 aa, Homo sapiens
IPKDTVVFV

SEQ ID NO: 4658 - protein, 9 aa, Homo sapiens
YPDVQTRVQ

SEQ ID NO: 4659 - protein, 9 aa, Homo sapiens
ALQWLLLLF

SEQ ID NO: 4660 - protein, 9 aa, Homo sapiens
FSNFILDKF

SEQ ID NO: 4661 - protein, 9 aa, Homo sapiens
YFPNPVRTV

SEQ ID NO: 4662 - protein, 9 aa, Homo sapiens
DPRPLTVVA

SEQ ID NO: 4663 - protein, 9 aa, Homo sapiens
QRRAAHSMM

SEQ ID NO: 4664 - protein, 9 aa, Homo sapiens
VQRRAAHSM

SEQ ID NO: 4665 - protein, 9 aa, Homo sapiens
AFASFRVVS

SEQ ID NO: 4666 - protein, 9 aa, Homo sapiens
GSCPIVVLN

SEQ ID NO: 4667 - protein, 9 aa, Homo sapiens
VGQAAHLSF

SEQ ID NO: 4668 - protein, 9 aa, Homo sapiens
IKPKSFKVN

SEQ ID NO: 4669 - protein, 9 aa, Homo sapiens
RANPNEPAK

SEQ ID NO: 4670 - protein, 9 aa, Homo sapiens
INKDLTSRV

SEQ ID NO: 4671 - protein, 9 aa, Homo sapiens
FSSFVPVTI

SEQ ID NO: 4672 - protein, 9 aa, Homo sapiens
RFSSFVPVT

SEQ ID NO: 4673 - protein, 9 aa, Homo sapiens
GDQPNLPYV

SEQ ID NO: 4674 - protein, 9 aa, Homo sapiens
ELDQVVGRD

SEQ ID NO: 4675 - protein, 9 aa, Homo sapiens
QAELDQVVG

SEQ ID NO: 4676 - protein, 9 aa, Homo sapiens
TRYPDVQTR

SEQ ID NO: 4677 - protein, 9 aa, Homo sapiens
LDLENVPAT

SEQ ID NO: 4678 - protein, 9 aa, Homo sapiens
ILSAEKKAA

SEQ ID NO: 4679 - protein, 9 aa, Homo sapiens
ILDKFLRHC

SEQ ID NO: 4680 - protein, 9 aa, Homo sapiens
NEEFGRTVG

SEQ ID NO: 4681 - protein, 9 aa, Homo sapiens
HNEEFGRTV

SEQ ID NO: 4682 - protein, 9 aa, Homo sapiens
ELVALLVRG

SEQ ID NO: 4683 - protein, 9 aa, Homo sapiens
TRQPRSRQV

SEQ ID NO: 4684 - protein, 9 aa, Homo sapiens
FTRQPRSRQ

SEQ ID NO: 4685 - protein, 9 aa, Homo sapiens
HWKVQRRAA

SEQ ID NO: 4686 - protein, 9 aa, Homo sapiens
YSEHWKVQR

SEQ ID NO: 4687 - protein, 9 aa, Homo sapiens
IVVLNGERA

SEQ ID NO: 4688 - protein, 9 aa, Homo sapiens
SFARLARRY

SEQ ID NO: 4689 - protein, 9 aa, Homo sapiens
SAPPGPFAW

SEQ ID NO: 4690 - protein, 9 aa, Homo sapiens
RSAPPGPFA

SEQ ID NO: 4691 - protein, 9 aa, Homo sapiens
RLLRQRRRQ

SEQ ID NO: 4692 - protein, 9 aa, Homo sapiens
SLSPNDPWP

SEQ ID NO: 4693 - protein, 9 aa, Homo sapiens
ELLDSAVQN

SEQ ID NO: 4694 - protein, 9 aa, Homo sapiens
KVNVTLRES

SEQ ID NO: 4695 - protein, 9 aa, Homo sapiens
PKSFKVNVT

SEQ ID NO: 4696 - protein, 9 aa, Homo sapiens
IGEELSKMQ

SEQ ID NO: 4697 - protein, 9 aa, Homo sapiens
FSVGKRRCI

SEQ ID NO: 4698 - protein, 9 aa, Homo sapiens
GYHIPKDTV

SEQ ID NO: 4699 - protein, 9 aa, Homo sapiens
TTANTSVLG

SEQ ID NO: 4700 - protein, 9 aa, Homo sapiens
FLYEAMRFS

SEQ ID NO: 4701 - protein, 9 aa, Homo sapiens
AELDQVVGR

SEQ ID NO: 4702 - protein, 9 aa, Homo sapiens
VQAELDQVV

SEQ ID NO: 4703 - protein, 9 aa, Homo sapiens
PDVQTRVQA

SEQ ID NO: 4704 - protein, 9 aa, Homo sapiens
ENVPATITD

SEQ ID NO: 4705 - protein, 9 aa, Homo sapiens
GDSHGGGAR

SEQ ID NO: 4706 - protein, 9 aa, Homo sapiens
LSAEKKAAG

SEQ ID NO: 4707 - protein, 9 aa, Homo sapiens
GAAPRDMMD

SEQ ID NO: 4708 - protein, 9 aa, Homo sapiens
LRPGAAPRD

SEQ ID NO: 4709 - protein, 9 aa, Homo sapiens
LQYFPNPVR

SEQ ID NO: 4710 - protein, 9 aa, Homo sapiens
VGAGSLVDV

SEQ ID NO: 4711 - protein, 9 aa, Homo sapiens
TVGAGSLVD

SEQ ID NO: 4712 - protein, 9 aa, Homo sapiens
EEFGRTVGA

SEQ ID NO: 4713 - protein, 9 aa, Homo sapiens
VVAVANVMS

SEQ ID NO: 4714 - protein, 9 aa, Homo sapiens
PLTVVAVAN

SEQ ID NO: 4715 - protein, 9 aa, Homo sapiens
PRPLTVVAV

SEQ ID NO: 4716 - protein, 9 aa, Homo sapiens
FLDPRPLTV

SEQ ID NO: 4717 - protein, 9 aa, Homo sapiens
AFLDPRPLT

SEQ ID NO: 4718 - protein, 9 aa, Homo sapiens
DGAFLDPRP

SEQ ID NO: 4719 - protein, 9 aa, Homo sapiens
GSADGAFLD

SEQ ID NO: 4720 - protein, 9 aa, Homo sapiens
LVALLVRGS

SEQ ID NO: 4721 - protein, 9 aa, Homo sapiens
QVLEGHVLS

SEQ ID NO: 4722 - protein, 9 aa, Homo sapiens
RAAHSMMRN

SEQ ID NO: 4723 - protein, 9 aa, Homo sapiens
HYSEHWKVQ

SEQ ID NO: 4724 - protein, 9 aa, Homo sapiens
VVSGGRSMA

SEQ ID NO: 4725 - protein, 9 aa, Homo sapiens
FASFRVVSG

SEQ ID NO: 4726 - protein, 9 aa, Homo sapiens
PAFASFRVV

SEQ ID NO: 4727 - protein, 9 aa, Homo sapiens
GSAFADRPA

SEQ ID NO: 4728 - protein, 9 aa, Homo sapiens
VVLNGERAI

SEQ ID NO: 4729 - protein, 9 aa, Homo sapiens
IRLGSCPIV

SEQ ID NO: 4730 - protein, 9 aa, Homo sapiens
GDVFQIRLG

SEQ ID NO: 4731 - protein, 9 aa, Homo sapiens
AAAVGQAAH

SEQ ID NO: 4732 - protein, 9 aa, Homo sapiens
IGNAAAVGQ

SEQ ID NO: 4733 - protein, 9 aa, Homo sapiens
QRLLRQRRR

SEQ ID NO: 4734 - protein, 9 aa, Homo sapiens
GQRLLRQRR

SEQ ID NO: 4735 - protein, 9 aa, Homo sapiens
LLSVLATVH

SEQ ID NO: 4736 - protein, 9 aa, Homo sapiens
QNLQAKETC

SEQ ID NO: 4737 - protein, 9 aa, Homo sapiens
SAVQNLQAK

SEQ ID NO: 4738 - protein, 9 aa, Homo sapiens
SFKVNVTLR

SEQ ID NO: 4739 - protein, 9 aa, Homo sapiens
KPKSFKVNV

SEQ ID NO: 4740 - protein, 9 aa, Homo sapiens
TIKPKSFKV

SEQ ID NO: 4741 - protein, 9 aa, Homo sapiens
LTIKPKSFK

SEQ ID NO: 4742 - protein, 9 aa, Homo sapiens
YGLTIKPKS

SEQ ID NO: 4743 - protein, 9 aa, Homo sapiens
EPAKMNFSY

SEQ ID NO: 4744 - protein, 9 aa, Homo sapiens
DFRANPNEP

SEQ ID NO: 4745 - protein, 9 aa, Homo sapiens
LAHQCDFRA

SEQ ID NO: 4746 - protein, 9 aa, Homo sapiens
ILAHQCDFR

SEQ ID NO: 4747 - protein, 9 aa, Homo sapiens
GKRRCIGEE

SEQ ID NO: 4748 - protein, 9 aa, Homo sapiens
TSRVMIFSV

SEQ ID NO: 4749 - protein, 9 aa, Homo sapiens
KDLTSRVMI

SEQ ID NO: 4750 - protein, 9 aa, Homo sapiens
NFDPARFLD

SEQ ID NO: 4751 - protein, 9 aa, Homo sapiens
NPENFDPAR

SEQ ID NO: 4752 - protein, 9 aa, Homo sapiens
PLKWPNPEN

SEQ ID NO: 4753 - protein, 9 aa, Homo sapiens
FVNQWSVNH

SEQ ID NO: 4754 - protein, 9 aa, Homo sapiens
KDTVVFVNQ

SEQ ID NO: 4755 - protein, 9 aa, Homo sapiens
PKDTVVFVN

SEQ ID NO: 4756 - protein, 9 aa, Homo sapiens
VTIPHATTA

SEQ ID NO: 4757 - protein, 9 aa, Homo sapiens
FVPVTIPHA

SEQ ID NO: 4758 - protein, 9 aa, Homo sapiens
SSFVPVTIP

SEQ ID NO: 4759 - protein, 9 aa, Homo sapiens
QPNLPYVLA

SEQ ID NO: 4760 - protein, 9 aa, Homo sapiens
DRLPCMGDQ

SEQ ID NO: 4761 - protein, 9 aa, Homo sapiens
QVVGRDRLP

SEQ ID NO: 4762 - protein, 9 aa, Homo sapiens
LDQVVGRDR

SEQ ID NO: 4763 - protein, 9 aa, Homo sapiens
RYPDVQTRV

SEQ ID NO: 4764 - protein, 9 aa, Homo sapiens
FTRYPDVQT

SEQ ID NO: 4765 - protein, 9 aa, Homo sapiens
LFTRYPDVQ

SEQ ID NO: 4766 - protein, 9 aa, Homo sapiens
GASQDTLST

SEQ ID NO: 4767 - protein, 9 aa, Homo sapiens
TITDIFGAS

SEQ ID NO: 4768 - protein, 9 aa, Homo sapiens
DLENVPATI

SEQ ID NO: 4769 - protein, 9 aa, Homo sapiens
ARLDLENVP

SEQ ID NO: 4770 - protein, 9 aa, Homo sapiens
GGARLDLEN

SEQ ID NO: 4771 - protein, 9 aa, Homo sapiens
SLRPGAAPR

SEQ ID NO: 4772 - protein, 9 aa, Homo sapiens
ESLRPGAAP

SEQ ID NO: 4773 - protein, 9 aa, Homo sapiens
CESLRPGAA

SEQ ID NO: 4774 - protein, 9 aa, Homo sapiens
HCESLRPGA

SEQ ID NO: 4775 - protein, 9 aa, Homo sapiens
FILDKFLRH

SEQ ID NO: 4776 - protein, 9 aa, Homo sapiens
REFEQLNRN

SEQ ID NO: 4777 - protein, 9 aa, Homo sapiens
NPVRTVFRE

SEQ ID NO: 4778 - protein, 9 aa, Homo sapiens
PNPVRTVFR

SEQ ID NO: 4779 - protein, 9 aa, Homo sapiens
GSLVDVMPW

SEQ ID NO: 4780 - protein, 9 aa, Homo sapiens
AGSLVDVMP

SEQ ID NO: 4781 - protein, 9 aa, Homo sapiens
EFGRTVGAG

SEQ ID NO: 4782 - protein, 9 aa, Homo sapiens
YSHDDPEFR

SEQ ID NO: 4783 - protein, 9 aa, Homo sapiens
AVCFGCRYS

SEQ ID NO: 4784 - protein, 9 aa, Homo sapiens
VANVMSAVC

SEQ ID NO: 4785 - protein, 9 aa, Homo sapiens
AVANVMSAV

SEQ ID NO: 4786 - protein, 9 aa, Homo sapiens
RPLTVVAVA

SEQ ID NO: 4787 - protein, 9 aa, Homo sapiens
LDPRPLTVV

SEQ ID NO: 4788 - protein, 9 aa, Homo sapiens
RELVALLVR

SEQ ID NO: 4789 - protein, 9 aa, Homo sapiens
LSEARELVA

SEQ ID NO: 4790 - protein, 9 aa, Homo sapiens
VLSEARELV

SEQ ID NO: 4791 - protein, 9 aa, Homo sapiens
EGHVLSEAR

SEQ ID NO: 4792 - protein, 9 aa, Homo sapiens
VLEGHVLSE

SEQ ID NO: 4793 - protein, 9 aa, Homo sapiens
PRSRQVLEG

SEQ ID NO: 4794 - protein, 9 aa, Homo sapiens
FFTRQPRSR

SEQ ID NO: 4795 - protein, 9 aa, Homo sapiens
NFFTRQPRS

SEQ ID NO: 4796 - protein, 9 aa, Homo sapiens
WKVQRRAAH

SEQ ID NO: 4797 - protein, 9 aa, Homo sapiens
SEHWKVQRR

SEQ ID NO: 4798 - protein, 9 aa, Homo sapiens
FRVVSGGRS

SEQ ID NO: 4799 - protein, 9 aa, Homo sapiens
RPAFASFRV

SEQ ID NO: 4800 - protein, 9 aa, Homo sapiens
AFADRPAFA

SEQ ID NO: 4801 - protein, 9 aa, Homo sapiens
QGSAFADRP

SEQ ID NO: 4802 - protein, 9 aa, Homo sapiens
AIHQALVQQ

SEQ ID NO: 4803 - protein, 9 aa, Homo sapiens
RLGSCPIVV

SEQ ID NO: 4804 - protein, 9 aa, Homo sapiens
ARRYGDVFQ

SEQ ID NO: 4805 - protein, 9 aa, Homo sapiens
FARLARRYG

SEQ ID NO: 4806 - protein, 9 aa, Homo sapiens
HLSFARLAR

SEQ ID NO: 4807 - protein, 9 aa, Homo sapiens
GNAAAVGQA

SEQ ID NO: 4808 - protein, 9 aa, Homo sapiens
PLIGNAAAV

SEQ ID NO: 4809 - protein, 9 aa, Homo sapiens
FAWPLIGNA

SEQ ID NO: 4810 - protein, 9 aa, Homo sapiens
RRRQLRSAP

SEQ ID NO: 4811 - protein, 9 aa, Homo sapiens
HVGQRLLRQ

SEQ ID NO: 4812 - protein, 9 aa, Homo sapiens
VLATVHVGQ

SEQ ID NO: 4813 - protein, 9 aa, Homo sapiens
SVLATVHVG

SEQ ID NO: 4814 - protein, 9 aa, Homo sapiens
DPWPLNPLS

SEQ ID NO: 4815 - protein, 9 aa, Homo sapiens
PNDPWPLNP

SEQ ID NO: 4816 - protein, 9 aa, Homo sapiens
SPNDPWPLN

SEQ ID NO: 4817 - protein, 9 aa, Homo sapiens
GTSLSPNDP

SEQ ID NO: 4818 - protein, 9 aa, Homo sapiens
DSAVQNLQA

SEQ ID NO: 4819 - protein, 9 aa, Homo sapiens
MELLDSAVQ

SEQ ID NO: 4820 - protein, 9 aa, Homo sapiens
SMELLDSAV

SEQ ID NO: 4821 - protein, 9 aa, Homo sapiens
ESMELLDSA

SEQ ID NO: 4822 - protein, 9 aa, Homo sapiens
FKVNVTLRE

SEQ ID NO: 4823 - protein, 9 aa, Homo sapiens
NFSYGLTIK

SEQ ID NO: 4824 - protein, 9 aa, Homo sapiens
NPNEPAKMN

SEQ ID NO: 4825 - protein, 9 aa, Homo sapiens
FRANPNEPA

SEQ ID NO: 4826 - protein, 9 aa, Homo sapiens
HQCDFRANP

SEQ ID NO: 4827 - protein, 9 aa, Homo sapiens
ISILAHQCD

SEQ ID NO: 4828 - protein, 9 aa, Homo sapiens
FLFISILAH

SEQ ID NO: 4829 - protein, 9 aa, Homo sapiens
SVGKRRCIG

SEQ ID NO: 4830 - protein, 9 aa, Homo sapiens
MIFSVGKRR

SEQ ID NO: 4831 - protein, 9 aa, Homo sapiens
RVMIFSVGK

SEQ ID NO: 4832 - protein, 9 aa, Homo sapiens
SRVMIFSVG

SEQ ID NO: 4833 - protein, 9 aa, Homo sapiens
LTSRVMIFS

SEQ ID NO: 4834 - protein, 9 aa, Homo sapiens
GLINKDLTS

SEQ ID NO: 4835 - protein, 9 aa, Homo sapiens
DGLINKDLT

SEQ ID NO: 4836 - protein, 9 aa, Homo sapiens
DKDGLINKD

SEQ ID NO: 4837 - protein, 9 aa, Homo sapiens
LDKDGLINK

SEQ ID NO: 4838 - protein, 9 aa, Homo sapiens
PNPENFDPA

SEQ ID NO: 4839 - protein, 9 aa, Homo sapiens
WPNPENFDP

SEQ ID NO: 4840 - protein, 9 aa, Homo sapiens
DPLKWPNPE

SEQ ID NO: 4841 - protein, 9 aa, Homo sapiens
VNHDPLKWP

SEQ ID NO: 4842 - protein, 9 aa, Homo sapiens
VFVNQWSVN

SEQ ID NO: 4843 - protein, 9 aa, Homo sapiens
VVFVNQWSV

SEQ ID NO: 4844 - protein, 9 aa, Homo sapiens
DTVVFVNQW

SEQ ID NO: 4845 - protein, 9 aa, Homo sapiens
VLGYHIPKD

SEQ ID NO: 4846 - protein, 9 aa, Homo sapiens
TSVLGYHIP

SEQ ID NO: 4847 - protein, 9 aa, Homo sapiens
NTSVLGYHI

SEQ ID NO: 4848 - protein, 9 aa, Homo sapiens
TANTSVLGY

SEQ ID NO: 4849 - protein, 9 aa, Homo sapiens
IPHATTANT

SEQ ID NO: 4850 - protein, 9 aa, Homo sapiens
TIPHATTAN

SEQ ID NO: 4851 - protein, 9 aa, Homo sapiens
PVTIPHATT

SEQ ID NO: 4852 - protein, 9 aa, Homo sapiens
VPVTIPHAT

SEQ ID NO: 4853 - protein, 9 aa, Homo sapiens
SFVPVTIPH

SEQ ID NO: 4854 - protein, 9 aa, Homo sapiens
MRFSSFVPV

SEQ ID NO: 4855 - protein, 9 aa, Homo sapiens
AMRFSSFVP

SEQ ID NO: 4856 - protein, 9 aa, Homo sapiens
LYEAMRFSS

SEQ ID NO: 4857 - protein, 9 aa, Homo sapiens
YVLAFLYEA

SEQ ID NO: 4858 - protein, 9 aa, Homo sapiens
MGDQPNLPY

SEQ ID NO: 4859 - protein, 9 aa, Homo sapiens
CMGDQPNLP

SEQ ID NO: 4860 - protein, 9 aa, Homo sapiens
GRDRLPCMG

SEQ ID NO: 4861 - protein, 9 aa, Homo sapiens
TRVQAELDQ

SEQ ID NO: 4862 - protein, 9 aa, Homo sapiens
DVQTRVQAE

SEQ ID NO: 4863 - protein, 9 aa, Homo sapiens
LLLLFTRYP

SEQ ID NO: 4864 - protein, 9 aa, Homo sapiens
WLLLLFTRY

SEQ ID NO: 4865 - protein, 9 aa, Homo sapiens
ASQDTLSTA

SEQ ID NO: 4866 - protein, 9 aa, Homo sapiens
TDIFGASQD

SEQ ID NO: 4867 - protein, 9 aa, Homo sapiens
ITDIFGASQ

SEQ ID NO: 4868 - protein, 9 aa, Homo sapiens
LENVPATIT

SEQ ID NO: 4869 - protein, 9 aa, Homo sapiens
RLDLENVPA

SEQ ID NO: 4870 - protein, 9 aa, Homo sapiens
KAAGDSHGG

SEQ ID NO: 4871 - protein, 9 aa, Homo sapiens
KKAAGDSHG

SEQ ID NO: 4872 - protein, 9 aa, Homo sapiens
SAEKKAAGD

SEQ ID NO: 4873 - protein, 9 aa, Homo sapiens
MDAFILSAE

SEQ ID NO: 4874 - protein, 9 aa, Homo sapiens
LRHCESLRP

SEQ ID NO: 4875 - protein, 9 aa, Homo sapiens
NFSNFILDK

SEQ ID NO: 4876 - protein, 9 aa, Homo sapiens
FEQLNRNFS

SEQ ID NO: 4877 - protein, 9 aa, Homo sapiens
VRTVFREFE

SEQ ID NO: 4878 - protein, 9 aa, Homo sapiens
PWLQYFPNP

SEQ ID NO: 4879 - protein, 9 aa, Homo sapiens
LVDVMPWLQ

SEQ ID NO: 4880 - protein, 9 aa, Homo sapiens
LLSHNEEFG

SEQ ID NO: 4881 - protein, 9 aa, Homo sapiens
EFRELLSHN

SEQ ID NO: 4882 - protein, 9 aa, Homo sapiens
VCFGCRYSH

SEQ ID NO: 4883 - protein, 9 aa, Homo sapiens
SAVCFGCRY

SEQ ID NO: 4884 - protein, 9 aa, Homo sapiens
MSAVCFGCR

SEQ ID NO: 4885 - protein, 9 aa, Homo sapiens
VAVANVMSA

SEQ ID NO: 4886 - protein, 9 aa, Homo sapiens
LTVVAVANV

SEQ ID NO: 4887 - protein, 9 aa, Homo sapiens
ALLVRGSAD

SEQ ID NO: 4888 - protein, 9 aa, Homo sapiens
QPRSRQVLE

SEQ ID NO: 4889 - protein, 9 aa, Homo sapiens
MRNFFTRQP

SEQ ID NO: 4890 - protein, 9 aa, Homo sapiens
MMRNFFTRQ

SEQ ID NO: 4891 - protein, 9 aa, Homo sapiens
SMMRNFFTR

SEQ ID NO: 4892 - protein, 9 aa, Homo sapiens
MAFGHYSEH

SEQ ID NO: 4893 - protein, 9 aa, Homo sapiens
SMAFGHYSE

SEQ ID NO: 4894 - protein, 9 aa, Homo sapiens
GRSMAFGHY

SEQ ID NO: 4895 - protein, 9 aa, Homo sapiens
FADRPAFAS

SEQ ID NO: 4896 - protein, 9 aa, Homo sapiens
VQQGSAFAD

SEQ ID NO: 4897 - protein, 9 aa, Homo sapiens
LVQQGSAFA

SEQ ID NO: 4898 - protein, 9 aa, Homo sapiens
RAIHQALVQ

SEQ ID NO: 4899 - protein, 9 aa, Homo sapiens
ERAIHQALV

SEQ ID NO: 4900 - protein, 9 aa, Homo sapiens
NGERAIHQA

SEQ ID NO: 4901 - protein, 9 aa, Homo sapiens
VLNGERAIH

SEQ ID NO: 4902 - protein, 9 aa, Homo sapiens
PIVVLNGER

SEQ ID NO: 4903 - protein, 9 aa, Homo sapiens
DVFQIRLGS

SEQ ID NO: 4904 - protein, 9 aa, Homo sapiens
RRYGDVFQI

SEQ ID NO: 4905 - protein, 9 aa, Homo sapiens
LSFARLARR

SEQ ID NO: 4906 - protein, 9 aa, Homo sapiens
QAAHLSFAR

SEQ ID NO: 4907 - protein, 9 aa, Homo sapiens
GQAAHLSFA

SEQ ID NO: 4908 - protein, 9 aa, Homo sapiens
NAAAVGQAA

SEQ ID NO: 4909 - protein, 9 aa, Homo sapiens
LIGNAAAVG

SEQ ID NO: 4910 - protein, 9 aa, Homo sapiens
WPLIGNAAA

SEQ ID NO: 4911 - protein, 9 aa, Homo sapiens
PFAWPLIGN

SEQ ID NO: 4912 - protein, 9 aa, Homo sapiens
GPFAWPLIG

SEQ ID NO: 4913 - protein, 9 aa, Homo sapiens
APPGPFAWP

SEQ ID NO: 4914 - protein, 9 aa, Homo sapiens
QLRSAPPGP

SEQ ID NO: 4915 - protein, 9 aa, Homo sapiens
QRRRQLRSA

SEQ ID NO: 4916 - protein, 9 aa, Homo sapiens
RQRRRQLRS

SEQ ID NO: 4917 - protein, 9 aa, Homo sapiens
VGQRLLRQR

SEQ ID NO: 4918 - protein, 9 aa, Homo sapiens
LATVHVGQR

SEQ ID NO: 4919 - protein, 9 aa, Homo sapiens
LSVLATVHV

SEQ ID NO: 4920 - protein, 9 aa, Homo sapiens
LLLLSVLAT

SEQ ID NO: 4921 - protein, 9 aa, Homo sapiens
LLLLLSVLA

SEQ ID NO: 4922 - protein, 9 aa, Homo sapiens
PLNPLSIQQ

SEQ ID NO: 4923 - protein, 9 aa, Homo sapiens
PWPLNPLSI

SEQ ID NO: 4924 - protein, 9 aa, Homo sapiens
TSLSPNDPW

SEQ ID NO: 4925 - protein, 9 aa, Homo sapiens
VQNLQAKET

SEQ ID NO: 4926 - protein, 9 aa, Homo sapiens
LDSAVQNLQ

SEQ ID NO: 4927 - protein, 9 aa, Homo sapiens
RESMELLDS

SEQ ID NO: 4928 - protein, 9 aa, Homo sapiens
LRESMELLD

SEQ ID NO: 4929 - protein, 9 aa, Homo sapiens
SYGLTIKPK

SEQ ID NO: 4930 - protein, 9 aa, Homo sapiens
FSYGLTIKP

SEQ ID NO: 4931 - protein, 9 aa, Homo sapiens
MNFSYGLTI

SEQ ID NO: 4932 - protein, 9 aa, Homo sapiens
PAKMNFSYG

SEQ ID NO: 4933 - protein, 9 aa, Homo sapiens
NEPAKMNFS

SEQ ID NO: 4934 - protein, 9 aa, Homo sapiens
CDFRANPNE

SEQ ID NO: 4935 - protein, 9 aa, Homo sapiens
FISILAHQC

SEQ ID NO: 4936 - protein, 9 aa, Homo sapiens
SKMQLFLFI

SEQ ID NO: 4937 - protein, 9 aa, Homo sapiens
RCIGEELSK

SEQ ID NO: 4938 - protein, 9 aa, Homo sapiens
RRCIGEELS

SEQ ID NO: 4939 - protein, 9 aa, Homo sapiens
VMIFSVGKR

SEQ ID NO: 4940 - protein, 9 aa, Homo sapiens
LINKDLTSR

SEQ ID NO: 4941 - protein, 9 aa, Homo sapiens
FLDKDGLIN

SEQ ID NO: 4942 - protein, 9 aa, Homo sapiens
RFLDKDGLI

SEQ ID NO: 4943 - protein, 9 aa, Homo sapiens
DPARFLDKD

SEQ ID NO: 4944 - protein, 9 aa, Homo sapiens
KWPNPENFD

SEQ ID NO: 4945 - protein, 9 aa, Homo sapiens
HDPLKWPNP

SEQ ID NO: 4946 - protein, 9 aa, Homo sapiens
SVNHDPLKW

SEQ ID NO: 4947 - protein, 9 aa, Homo sapiens
WSVNHDPLK

SEQ ID NO: 4948 - protein, 9 aa, Homo sapiens
VNQWSVNHD

SEQ ID NO: 4949 - protein, 9 aa, Homo sapiens
TVVFVNQWS

SEQ ID NO: 4950 - protein, 9 aa, Homo sapiens
LGYHIPKDT

SEQ ID NO: 4951 - protein, 9 aa, Homo sapiens
SVLGYHIPK

SEQ ID NO: 4952 - protein, 9 aa, Homo sapiens
EAMRFSSFV

SEQ ID NO: 4953 - protein, 9 aa, Homo sapiens
LPYVLAFLY

SEQ ID NO: 4954 - protein, 9 aa, Homo sapiens
LPCMGDQPN

SEQ ID NO: 4955 - protein, 9 aa, Homo sapiens
RDRLPCMGD

SEQ ID NO: 4956 - protein, 9 aa, Homo sapiens
VVGRDRLPC

SEQ ID NO: 4957 - protein, 9 aa, Homo sapiens
QTRVQAELD

SEQ ID NO: 4958 - protein, 9 aa, Homo sapiens
LLFTRYPDV

SEQ ID NO: 4959 - protein, 9 aa, Homo sapiens
LLLFTRYPD

SEQ ID NO: 4960 - protein, 9 aa, Homo sapiens
QWLLLLFTR

SEQ ID NO: 4961 - protein, 9 aa, Homo sapiens
FGASQDTLS

SEQ ID NO: 4962 - protein, 9 aa, Homo sapiens
DIFGASQDT

SEQ ID NO: 4963 - protein, 9 aa, Homo sapiens
ATITDIFGA

SEQ ID NO: 4964 - protein, 9 aa, Homo sapiens
NVPATITDI

SEQ ID NO: 4965 - protein, 9 aa, Homo sapiens
GARLDLENV

SEQ ID NO: 4966 - protein, 9 aa, Homo sapiens
GGGARLDLE

SEQ ID NO: 4967 - protein, 9 aa, Homo sapiens
AAGDSHGGG

SEQ ID NO: 4968 - protein, 9 aa, Homo sapiens
EKKAAGDSH

SEQ ID NO: 4969 - protein, 9 aa, Homo sapiens
AEKKAAGDS

SEQ ID NO: 4970 - protein, 9 aa, Homo sapiens
DAFILSAEK

SEQ ID NO: 4971 - protein, 9 aa, Homo sapiens
MMDAFILSA

SEQ ID NO: 4972 - protein, 9 aa, Homo sapiens
DMMDAFILS

SEQ ID NO: 4973 - protein, 9 aa, Homo sapiens
AAPRDMMDA

SEQ ID NO: 4974 - protein, 9 aa, Homo sapiens
DKFLRHCES

SEQ ID NO: 4975 - protein, 9 aa, Homo sapiens
LDKFLRHCE

SEQ ID NO: 4976 - protein, 9 aa, Homo sapiens
NFILDKFLR

SEQ ID NO: 4977 - protein, 9 aa, Homo sapiens
RNFSNFILD

SEQ ID NO: 4978 - protein, 9 aa, Homo sapiens
EQLNRNFSN

SEQ ID NO: 4979 - protein, 9 aa, Homo sapiens
FREFEQLNR

SEQ ID NO: 4980 - protein, 9 aa, Homo sapiens
VFREFEQLN

SEQ ID NO: 4981 - protein, 9 aa, Homo sapiens
RTVFREFEQ

SEQ ID NO: 4982 - protein, 9 aa, Homo sapiens
WLQYFPNPV

SEQ ID NO: 4983 - protein, 9 aa, Homo sapiens
VDVMPWLQY

SEQ ID NO: 4984 - protein, 9 aa, Homo sapiens
RTVGAGSLV

SEQ ID NO: 4985 - protein, 9 aa, Homo sapiens
RELLSHNEE

SEQ ID NO: 4986 - protein, 9 aa, Homo sapiens
FRELLSHNE

SEQ ID NO: 4987 - protein, 9 aa, Homo sapiens
DPEFRELLS

SEQ ID NO: 4988 - protein, 9 aa, Homo sapiens
GCRYSHDDP

SEQ ID NO: 4989 - protein, 9 aa, Homo sapiens
VMSAVCFGC

SEQ ID NO: 4990 - protein, 9 aa, Homo sapiens
NVMSAVCFG

SEQ ID NO: 4991 - protein, 9 aa, Homo sapiens
SADGAFLDP

SEQ ID NO: 4992 - protein, 9 aa, Homo sapiens
LVRGSADGA

SEQ ID NO: 4993 - protein, 9 aa, Homo sapiens
LLVRGSADG

SEQ ID NO: 4994 - protein, 9 aa, Homo sapiens
VALLVRGSA

SEQ ID NO: 4995 - protein, 9 aa, Homo sapiens
ARELVALLV

SEQ ID NO: 4996 - protein, 9 aa, Homo sapiens
LEGHVLSEA

SEQ ID NO: 4997 - protein, 9 aa, Homo sapiens
SRQVLEGHV

SEQ ID NO: 4998 - protein, 9 aa, Homo sapiens
RSRQVLEGH

SEQ ID NO: 4999 - protein, 9 aa, Homo sapiens
RNFFTRQPR

SEQ ID NO: 5000 - protein, 9 aa, Homo sapiens
RRAAHSMMR

SEQ ID NO: 5001 - protein, 9 aa, Homo sapiens
GGRSMAFGH

SEQ ID NO: 5002 - protein, 9 aa, Homo sapiens
SGGRSMAFG

SEQ ID NO: 5003 - protein, 9 aa, Homo sapiens
SFRVVSGGR

SEQ ID NO: 5004 - protein, 9 aa, Homo sapiens
ASFRVVSGG

SEQ ID NO: 5005 - protein, 9 aa, Homo sapiens
QALVQQGSA

SEQ ID NO: 5006 - protein, 9 aa, Homo sapiens
HQALVQQGS

SEQ ID NO: 5007 - protein, 9 aa, Homo sapiens
LNGERAIHQ

SEQ ID NO: 5008 - protein, 9 aa, Homo sapiens
CPIVVLNGE

SEQ ID NO: 5009 - protein, 9 aa, Homo sapiens
SCPIVVLNG

SEQ ID NO: 5010 - protein, 9 aa, Homo sapiens
QIRLGSCPI

SEQ ID NO: 5011 - protein, 9 aa, Homo sapiens
RYGDVFQIR

SEQ ID NO: 5012 - protein, 9 aa, Homo sapiens
RLARRYGDV

SEQ ID NO: 5013 - protein, 9 aa, Homo sapiens
ARLARRYGD

SEQ ID NO: 5014 - protein, 9 aa, Homo sapiens
AVGQAAHLS

SEQ ID NO: 5015 - protein, 9 aa, Homo sapiens
AWPLIGNAA

SEQ ID NO: 5016 - protein, 9 aa, Homo sapiens
PGPFAWPLI

SEQ ID NO: 5017 - protein, 9 aa, Homo sapiens
RQLRSAPPG

SEQ ID NO: 5018 - protein, 9 aa, Homo sapiens
LRQRRRQLR

SEQ ID NO: 5019 - protein, 9 aa, Homo sapiens
LLLSVLATV

SEQ ID NO: 5020 - protein, 9 aa, Homo sapiens
TTLLLLLSV

SEQ ID NO: 5021 - protein, 9 aa, Homo sapiens
NPLSIQQTT

SEQ ID NO: 5022 - protein, 9 aa, Homo sapiens
LNPLSIQQT

SEQ ID NO: 5023 - protein, 9 aa, Homo sapiens
WPLNPLSIQ

SEQ ID NO: 5024 - protein, 9 aa, Homo sapiens
MGTSLSPND

SEQ ID NO: 5025 - protein, 9 aa, Homo sapiens
GRTVGAGSL

SEQ ID NO: 5026 - protein, 9 aa, Homo sapiens
QRLLRQRRR

SEQ ID NO: 5027 - protein, 9 aa, Homo sapiens
ARFLDKDGL

SEQ ID NO: 5028 - protein, 9 aa, Homo sapiens
FREFEQLNR

SEQ ID NO: 5029 - protein, 9 aa, Homo sapiens
RRAAHSMMR

SEQ ID NO: 5030 - protein, 9 aa, Homo sapiens
RRYGDVFQI

SEQ ID NO: 5031 - protein, 9 aa, Homo sapiens
TRYPDVQTR

SEQ ID NO: 5032 - protein, 9 aa, Homo sapiens
KRRCIGEEL

SEQ ID NO: 5033 - protein, 9 aa, Homo sapiens
NRNFSNFIL

SEQ ID NO: 5034 - protein, 9 aa, Homo sapiens
DRPAFASFR

SEQ ID NO: 5035 - protein, 9 aa, Homo sapiens
KSFKVNVTL

SEQ ID NO: 5036 - protein, 9 aa, Homo sapiens
RCIGEELSK

SEQ ID NO: 5037 - protein, 9 aa, Homo sapiens
VRGSADGAF

SEQ ID NO: 5038 - protein, 9 aa, Homo sapiens
GRSMAFGHY

SEQ ID NO: 5039 - protein, 9 aa, Homo sapiens
LRSAPPGPF

SEQ ID NO: 5040 - protein, 9 aa, Homo sapiens
LRQRRRQLR

SEQ ID NO: 5041 - protein, 9 aa, Homo sapiens
RELVALLVR

SEQ ID NO: 5042 - protein, 9 aa, Homo sapiens
QRRAAHSMM

SEQ ID NO: 5043 - protein, 9 aa, Homo sapiens
QLFLFISIL

SEQ ID NO: 5044 - protein, 9 aa, Homo sapiens
GEELSKMQL

SEQ ID NO: 5045 - protein, 9 aa, Homo sapiens
AFLYEAMRF

SEQ ID NO: 5046 - protein, 9 aa, Homo sapiens
AFILSAEKK

SEQ ID NO: 5047 - protein, 9 aa, Homo sapiens
PRDMMDAFI

SEQ ID NO: 5048 - protein, 9 aa, Homo sapiens
RQVLEGHVL

SEQ ID NO: 5049 - protein, 9 aa, Homo sapiens
RRRQLRSAP

SEQ ID NO: 5050 - protein, 9 aa, Homo sapiens
LTIKPKSFK

SEQ ID NO: 5051 - protein, 9 aa, Homo sapiens
PCMGDQPNL

SEQ ID NO: 5052 - protein, 9 aa, Homo sapiens
DSHGGGARL

SEQ ID NO: 5053 - protein, 9 aa, Homo sapiens
DAFILSAEK

SEQ ID NO: 5054 - protein, 9 aa, Homo sapiens
RYSHDDPEF

SEQ ID NO: 5055 - protein, 9 aa, Homo sapiens
GAFLDPRPL

SEQ ID NO: 5056 - protein, 9 aa, Homo sapiens
RNFFTRQPR

SEQ ID NO: 5057 - protein, 9 aa, Homo sapiens
IRLGSCPIV

SEQ ID NO: 5058 - protein, 9 aa, Homo sapiens
LSFARLARR

SEQ ID NO: 5059 - protein, 9 aa, Homo sapiens
RRQLRSAPP

SEQ ID NO: 5060 - protein, 9 aa, Homo sapiens
GQRLLRQRR

SEQ ID NO: 5061 - protein, 9 aa, Homo sapiens
TLLLLLSVL

SEQ ID NO: 5062 - protein, 9 aa, Homo sapiens
VTLRESMEL

SEQ ID NO: 5063 - protein, 9 aa, Homo sapiens
RANPNEPAK

SEQ ID NO: 5064 - protein, 9 aa, Homo sapiens
FLFISILAH

SEQ ID NO: 5065 - protein, 9 aa, Homo sapiens
RRCIGEELS

SEQ ID NO: 5066 - protein, 9 aa, Homo sapiens
MIFSVGKRR

SEQ ID NO: 5067 - protein, 9 aa, Homo sapiens
VMIFSVGKR

SEQ ID NO: 5068 - protein, 9 aa, Homo sapiens
RVMIFSVGK

SEQ ID NO: 5069 - protein, 9 aa, Homo sapiens
LINKDLTSR

SEQ ID NO: 5070 - protein, 9 aa, Homo sapiens
LDKDGLINK

SEQ ID NO: 5071 - protein, 9 aa, Homo sapiens
WLLLLFTRY

SEQ ID NO: 5072 - protein, 9 aa, Homo sapiens
QWLLLLFTR

SEQ ID NO: 5073 - protein, 9 aa, Homo sapiens
TALQWLLLL

SEQ ID NO: 5074 - protein, 9 aa, Homo sapiens
ARLDLENVP

SEQ ID NO: 5075 - protein, 9 aa, Homo sapiens
LRPGAAPRD

SEQ ID NO: 5076 - protein, 9 aa, Homo sapiens
EFEQLNRNF

SEQ ID NO: 5077 - protein, 9 aa, Homo sapiens
LQYFPNPVR

SEQ ID NO: 5078 - protein, 9 aa, Homo sapiens
RSRQVLEGH

SEQ ID NO: 5079 - protein, 9 aa, Homo sapiens
RQPRSRQVL

SEQ ID NO: 5080 - protein, 9 aa, Homo sapiens
RVVSGGRSM

SEQ ID NO: 5081 - protein, 9 aa, Homo sapiens
LGSCPIVVL

SEQ ID NO: 5082 - protein, 9 aa, Homo sapiens
AAHLSFARL

SEQ ID NO: 5083 - protein, 9 aa, Homo sapiens
AAVGQAAHL

SEQ ID NO: 5084 - protein, 9 aa, Homo sapiens
LSIQQTTLL

SEQ ID NO: 5085 - protein, 9 aa, Homo sapiens
GLTIKPKSF

SEQ ID NO: 5086 - protein, 9 aa, Homo sapiens
NFSYGLTIK

SEQ ID NO: 5087 - protein, 9 aa, Homo sapiens
PNEPAKMNF

SEQ ID NO: 5088 - protein, 9 aa, Homo sapiens
ELSKMQLFL

SEQ ID NO: 5089 - protein, 9 aa, Homo sapiens
KDGLINKDL

SEQ ID NO: 5090 - protein, 9 aa, Homo sapiens
ENFDPARFL

SEQ ID NO: 5091 - protein, 9 aa, Homo sapiens
SVLGYHIPK

SEQ ID NO: 5092 - protein, 9 aa, Homo sapiens
MRFSSFVPV

SEQ ID NO: 5093 - protein, 9 aa, Homo sapiens
LAFLYEAMR

SEQ ID NO: 5094 - protein, 9 aa, Homo sapiens
PNLPYVLAF

SEQ ID NO: 5095 - protein, 9 aa, Homo sapiens
DQVVGRDRL

SEQ ID NO: 5096 - protein, 9 aa, Homo sapiens
AELDQVVGR

SEQ ID NO: 5097 - protein, 9 aa, Homo sapiens
VQTRVQAEL

SEQ ID NO: 5098 - protein, 9 aa, Homo sapiens
IFGASQDTL

SEQ ID NO: 5099 - protein, 9 aa, Homo sapiens
GDSHGGGAR

SEQ ID NO: 5100 - protein, 9 aa, Homo sapiens
RDMMDAFIL

SEQ ID NO: 5101 - protein, 9 aa, Homo sapiens
SLRPGAAPR

SEQ ID NO: 5102 - protein, 9 aa, Homo sapiens
LRHCESLRP

SEQ ID NO: 5103 - protein, 9 aa, Homo sapiens
KFLRHCESL

SEQ ID NO: 5104 - protein, 9 aa, Homo sapiens
SNFILDKFL

SEQ ID NO: 5105 - protein, 9 aa, Homo sapiens
TVFREFEQL

SEQ ID NO: 5106 - protein, 9 aa, Homo sapiens
FPNPVRTVF

SEQ ID NO: 5107 - protein, 9 aa, Homo sapiens
FRELLSHNE

SEQ ID NO: 5108 - protein, 9 aa, Homo sapiens
PEFRELLSH

SEQ ID NO: 5109 - protein, 9 aa, Homo sapiens
VCFGCRYSH

SEQ ID NO: 5110 - protein, 9 aa, Homo sapiens
ANVMSAVCF

SEQ ID NO: 5111 - protein, 9 aa, Homo sapiens
RGSADGAFL

SEQ ID NO: 5112 - protein, 9 aa, Homo sapiens
ARELVALLV

SEQ ID NO: 5113 - protein, 9 aa, Homo sapiens
HVLSEAREL

SEQ ID NO: 5114 - protein, 9 aa, Homo sapiens
MAFGHYSEH

SEQ ID NO: 5115 - protein, 9 aa, Homo sapiens
ALVQQGSAF

SEQ ID NO: 5116 - protein, 9 aa, Homo sapiens
YGDVFQIRL

SEQ ID NO: 5117 - protein, 9 aa, Homo sapiens
RYGDVFQIR

SEQ ID NO: 5118 - protein, 9 aa, Homo sapiens
ARRYGDVFQ

SEQ ID NO: 5119 - protein, 9 aa, Homo sapiens
ATVHVGQRL

SEQ ID NO: 5120 - protein, 9 aa, Homo sapiens
PLSIQQTTL

SEQ ID NO: 5121 - protein, 9 aa, Homo sapiens
SAVQNLQAK

SEQ ID NO: 5122 - protein, 9 aa, Homo sapiens
SYGLTIKPK

SEQ ID NO: 5123 - protein, 9 aa, Homo sapiens
SILAHQCDF

SEQ ID NO: 5124 - protein, 9 aa, Homo sapiens
CIGEELSKM

SEQ ID NO: 5125 - protein, 9 aa, Homo sapiens
SRVMIFSVG

SEQ ID NO: 5126 - protein, 9 aa, Homo sapiens
RFLDKDGLI

SEQ ID NO: 5127 - protein, 9 aa, Homo sapiens
FVNQWSVNH

SEQ ID NO: 5128 - protein, 9 aa, Homo sapiens
HIPKDTVVF

SEQ ID NO: 5129 - protein, 9 aa, Homo sapiens
GRDRLPCMG

SEQ ID NO: 5130 - protein, 9 aa, Homo sapiens
TRVQAELDQ

SEQ ID NO: 5131 - protein, 9 aa, Homo sapiens
ALQWLLLLF

SEQ ID NO: 5132 - protein, 9 aa, Homo sapiens
LSTALQWLL

SEQ ID NO: 5133 - protein, 9 aa, Homo sapiens
SQDTLSTAL

SEQ ID NO: 5134 - protein, 9 aa, Homo sapiens
FILDKFLRH

SEQ ID NO: 5135 - protein, 9 aa, Homo sapiens
NFILDKFLR

SEQ ID NO: 5136 - protein, 9 aa, Homo sapiens
FSNFILDKF

SEQ ID NO: 5137 - protein, 9 aa, Homo sapiens
NFSNFILDK

SEQ ID NO: 5138 - protein, 9 aa, Homo sapiens
GAGSLVDVM

SEQ ID NO: 5139 - protein, 9 aa, Homo sapiens
ELLSHNEEF

SEQ ID NO: 5140 - protein, 9 aa, Homo sapiens
EARELVALL

SEQ ID NO: 5141 - protein, 9 aa, Homo sapiens
SEHWKVQRR

SEQ ID NO: 5142 - protein, 9 aa, Homo sapiens
VSGGRSMAF

SEQ ID NO: 5143 - protein, 9 aa, Homo sapiens
FRVVSGGRS

SEQ ID NO: 5144 - protein, 9 aa, Homo sapiens
ADRPAFASF

SEQ ID NO: 5145 - protein, 9 aa, Homo sapiens
SAFADRPAF

SEQ ID NO: 5146 - protein, 9 aa, Homo sapiens
GERAIHQAL

SEQ ID NO: 5147 - protein, 9 aa, Homo sapiens
PIVVLNGER

SEQ ID NO: 5148 - protein, 9 aa, Homo sapiens
ARLARRYGD

SEQ ID NO: 5149 - protein, 9 aa, Homo sapiens
AAAVGQAAH

SEQ ID NO: 5150 - protein, 9 aa, Homo sapiens
VHVGQRLLR

SEQ ID NO: 5151 - protein, 9 aa, Homo sapiens
TVHVGQRLL

SEQ ID NO: 5152 - protein, 9 aa, Homo sapiens
LLDSAVQNL

SEQ ID NO: 5153 - protein, 9 aa, Homo sapiens
SFKVNVTLR

SEQ ID NO: 5154 - protein, 9 aa, Homo sapiens
AKMNFSYGL

SEQ ID NO: 5155 - protein, 9 aa, Homo sapiens
ANPNEPAKM

SEQ ID NO: 5156 - protein, 9 aa, Homo sapiens
EELSKMQLF

SEQ ID NO: 5157 - protein, 9 aa, Homo sapiens
PENFDPARF

SEQ ID NO: 5158 - protein, 9 aa, Homo sapiens
LKWPNPENF

SEQ ID NO: 5159 - protein, 9 aa, Homo sapiens
WSVNHDPLK

SEQ ID NO: 5160 - protein, 9 aa, Homo sapiens
ATTANTSVL

SEQ ID NO: 5161 - protein, 9 aa, Homo sapiens
NLPYVLAFL

SEQ ID NO: 5162 - protein, 9 aa, Homo sapiens
DQPNLPYVL

SEQ ID NO: 5163 - protein, 9 aa, Homo sapiens
MGDQPNLPY

SEQ ID NO: 5164 - protein, 9 aa, Homo sapiens
DRLPCMGDQ

SEQ ID NO: 5165 - protein, 9 aa, Homo sapiens
HGGGARLDL

SEQ ID NO: 5166 - protein, 9 aa, Homo sapiens
QLNRNFSNF

SEQ ID NO: 5167 - protein, 9 aa, Homo sapiens
SLVDVMPWL

SEQ ID NO: 5168 - protein, 9 aa, Homo sapiens
HDDPEFREL

SEQ ID NO: 5169 - protein, 9 aa, Homo sapiens
CRYSHDDPE

SEQ ID NO: 5170 - protein, 9 aa, Homo sapiens
TVVAVANVM

SEQ ID NO: 5171 - protein, 9 aa, Homo sapiens
PRPLTVVAV

SEQ ID NO: 5172 - protein, 9 aa, Homo sapiens
SEARELVAL

SEQ ID NO: 5173 - protein, 9 aa, Homo sapiens
PRSRQVLEG

SEQ ID NO: 5174 - protein, 9 aa, Homo sapiens
TRQPRSRQV

SEQ ID NO: 5175 - protein, 9 aa, Homo sapiens
AAHSMMRNF

SEQ ID NO: 5176 - protein, 9 aa, Homo sapiens
YSEHWKVQR

SEQ ID NO: 5177 - protein, 9 aa, Homo sapiens
ERAIHQALV

SEQ ID NO: 5178 - protein, 9 aa, Homo sapiens
PPGPFAWPL

SEQ ID NO: 5179 - protein, 9 aa, Homo sapiens
LLRQRRRQL

SEQ ID NO: 5180 - protein, 9 aa, Homo sapiens
VGQRLLRQR

SEQ ID NO: 5181 - protein, 9 aa, Homo sapiens
LLSVLATVH

SEQ ID NO: 5182 - protein, 9 aa, Homo sapiens
QQTTLLLLL

SEQ ID NO: 5183 - protein, 9 aa, Homo sapiens
IQQTTLLLL

SEQ ID NO: 5184 - protein, 9 aa, Homo sapiens
SIQQTTLLL

SEQ ID NO: 5185 - protein, 9 aa, Homo sapiens
NDPWPLNPL

SEQ ID NO: 5186 - protein, 9 aa, Homo sapiens
TLRESMELL

SEQ ID NO: 5187 - protein, 9 aa, Homo sapiens
EPAKMNFSY

SEQ ID NO: 5188 - protein, 9 aa, Homo sapiens
FRANPNEPA

SEQ ID NO: 5189 - protein, 9 aa, Homo sapiens
DLTSRVMIF

SEQ ID NO: 5190 - protein, 9 aa, Homo sapiens
KDLTSRVMI

SEQ ID NO: 5191 - protein, 9 aa, Homo sapiens
NPENFDPAR

SEQ ID NO: 5192 - protein, 9 aa, Homo sapiens
SFVPVTIPH

SEQ ID NO: 5193 - protein, 9 aa, Homo sapiens
YEAMRFSSF

SEQ ID NO: 5194 - protein, 9 aa, Homo sapiens
LPYVLAFLY

SEQ ID NO: 5195 - protein, 9 aa, Homo sapiens
STALQWLLL

SEQ ID NO: 5196 - protein, 9 aa, Homo sapiens
RPGAAPRDM

SEQ ID NO: 5197 - protein, 9 aa, Homo sapiens
REFEQLNRN

SEQ ID NO: 5198 - protein, 9 aa, Homo sapiens
PVRTVFREF

SEQ ID NO: 5199 - protein, 9 aa, Homo sapiens
DVMPWLQYF

SEQ ID NO: 5200 - protein, 9 aa, Homo sapiens
VDVMPWLQY

SEQ ID NO: 5201 - protein, 9 aa, Homo sapiens
ADGAFLDPR

SEQ ID NO: 5202 - protein, 9 aa, Homo sapiens
EGHVLSEAR

SEQ ID NO: 5203 - protein, 9 aa, Homo sapiens
AHSMMRNFF

SEQ ID NO: 5204 - protein, 9 aa, Homo sapiens
WKVQRRAAH

SEQ ID NO: 5205 - protein, 9 aa, Homo sapiens
GGRSMAFGH

SEQ ID NO: 5206 - protein, 9 aa, Homo sapiens
SFRVVSGGR

SEQ ID NO: 5207 - protein, 9 aa, Homo sapiens
VLNGERAIH

SEQ ID NO: 5208 - protein, 9 aa, Homo sapiens
SFARLARRY

SEQ ID NO: 5209 - protein, 9 aa, Homo sapiens
QAAHLSFAR

SEQ ID NO: 5210 - protein, 9 aa, Homo sapiens
VGQAAHLSF

SEQ ID NO: 5211 - protein, 9 aa, Homo sapiens
QRRRQLRSA

SEQ ID NO: 5212 - protein, 9 aa, Homo sapiens
LATVHVGQR

SEQ ID NO: 5213 - protein, 9 aa, Homo sapiens
LRESMELLD

SEQ ID NO: 5214 - protein, 9 aa, Homo sapiens
VNVTLRESM

SEQ ID NO: 5215 - protein, 9 aa, Homo sapiens
MNFSYGLTI

SEQ ID NO: 5216 - protein, 9 aa, Homo sapiens
ILAHQCDFR

SEQ ID NO: 5217 - protein, 9 aa, Homo sapiens
MQLFLFISI

SEQ ID NO: 5218 - protein, 9 aa, Homo sapiens
LSKMQLFLF

SEQ ID NO: 5219 - protein, 9 aa, Homo sapiens
NKDLTSRVM

SEQ ID NO: 5220 - protein, 9 aa, Homo sapiens
FDPARFLDK

SEQ ID NO: 5221 - protein, 9 aa, Homo sapiens
ANTSVLGYH

SEQ ID NO: 5222 - protein, 9 aa, Homo sapiens
TANTSVLGY

SEQ ID NO: 5223 - protein, 9 aa, Homo sapiens
LDQVVGRDR

SEQ ID NO: 5224 - protein, 9 aa, Homo sapiens
RYPDVQTRV

SEQ ID NO: 5225 - protein, 9 aa, Homo sapiens
TLSTALQWL

SEQ ID NO: 5226 - protein, 9 aa, Homo sapiens
VPATITDIF

SEQ ID NO: 5227 - protein, 9 aa, Homo sapiens
NVPATITDI

SEQ ID NO: 5228 - protein, 9 aa, Homo sapiens
APRDMMDAF

SEQ ID NO: 5229 - protein, 9 aa, Homo sapiens
FLRHCESLR

SEQ ID NO: 5230 - protein, 9 aa, Homo sapiens
PNPVRTVFR

SEQ ID NO: 5231 - protein, 9 aa, Homo sapiens
LSHNEEFGR

SEQ ID NO: 5232 - protein, 9 aa, Homo sapiens
DDPEFRELL

SEQ ID NO: 5233 - protein, 9 aa, Homo sapiens
SAVCFGCRY

SEQ ID NO: 5234 - protein, 9 aa, Homo sapiens
SRQVLEGHV

SEQ ID NO: 5235 - protein, 9 aa, Homo sapiens
FFTRQPRSR

SEQ ID NO: 5236 - protein, 9 aa, Homo sapiens
MRNFFTRQP

SEQ ID NO: 5237 - protein, 9 aa, Homo sapiens
SMMRNFFTR

SEQ ID NO: 5238 - protein, 9 aa, Homo sapiens
FGHYSEHWK

SEQ ID NO: 5239 - protein, 9 aa, Homo sapiens
QQGSAFADR

SEQ ID NO: 5240 - protein, 9 aa, Homo sapiens
LARRYGDVF

SEQ ID NO: 5241 - protein, 9 aa, Homo sapiens
HLSFARLAR

SEQ ID NO: 5242 - protein, 9 aa, Homo sapiens
LSPNDPWPL

SEQ ID NO: 5243 - protein, 9 aa, Homo sapiens
SKMQLFLFI

SEQ ID NO: 5244 - protein, 9 aa, Homo sapiens
FSVGKRRCI

SEQ ID NO: 5245 - protein, 9 aa, Homo sapiens
QWSVNHDPL

SEQ ID NO: 5246 - protein, 9 aa, Homo sapiens
VGRDRLPCM

SEQ ID NO: 5247 - protein, 9 aa, Homo sapiens
VRTVFREFE

SEQ ID NO: 5248 - protein, 9 aa, Homo sapiens
RELLSHNEE

SEQ ID NO: 5249 - protein, 9 aa, Homo sapiens
YSHDDPEFR

SEQ ID NO: 5250 - protein, 9 aa, Homo sapiens
MSAVCFGCR

SEQ ID NO: 5251 - protein, 9 aa, Homo sapiens
RPLTVVAVA

SEQ ID NO: 5252 - protein, 9 aa, Homo sapiens
VQRRAAHSM

SEQ ID NO: 5253 - protein, 9 aa, Homo sapiens
VVLNGERAI

SEQ ID NO: 5254 - protein, 9 aa, Homo sapiens
QIRLGSCPI

SEQ ID NO: 5255 - protein, 9 aa, Homo sapiens
GLINKDLTS

SEQ ID NO: 5256 - protein, 9 aa, Homo sapiens
DKDGLINKD

SEQ ID NO: 5257 - protein, 9 aa, Homo sapiens
FSSFVPVTI

SEQ ID NO: 5258 - protein, 9 aa, Homo sapiens
VLAFLYEAM

SEQ ID NO: 5259 - protein, 9 aa, Homo sapiens
DLENVPATI

SEQ ID NO: 5260 - protein, 9 aa, Homo sapiens
EKKAAGDSH

SEQ ID NO: 5261 - protein, 9 aa, Homo sapiens
PGAAPRDMM

SEQ ID NO: 5262 - protein, 9 aa, Homo sapiens
GHVLSEARE

SEQ ID NO: 5263 - protein, 9 aa, Homo sapiens
GHYSEHWKV

SEQ ID NO: 5264 - protein, 9 aa, Homo sapiens
RAIHQALVQ

SEQ ID NO: 5265 - protein, 9 aa, Homo sapiens
RQLRSAPPG

SEQ ID NO: 5266 - protein, 9 aa, Homo sapiens
RQRRRQLRS

SEQ ID NO: 5267 - protein, 9 aa, Homo sapiens
PWPLNPLSI

SEQ ID NO: 5268 - protein, 9 aa, Homo sapiens
FSYGLTIKP

SEQ ID NO: 5269 - protein, 9 aa, Homo sapiens
YHIPKDTVV

SEQ ID NO: 5270 - protein, 9 aa, Homo sapiens
NTSVLGYHI

SEQ ID NO: 5271 - protein, 9 aa, Homo sapiens
RLDLENVPA

SEQ ID NO: 5272 - protein, 9 aa, Homo sapiens
RNFSNFILD

SEQ ID NO: 5273 - protein, 9 aa, Homo sapiens
LNRNFSNFI

SEQ ID NO: 5274 - protein, 9 aa, Homo sapiens
RTVGAGSLV

SEQ ID NO: 5275 - protein, 9 aa, Homo sapiens
NFFTRQPRS

SEQ ID NO: 5276 - protein, 9 aa, Homo sapiens
RAAHSMMRN

SEQ ID NO: 5277 - protein, 9 aa, Homo sapiens
RLLRQRRRQ

SEQ ID NO: 5278 - protein, 9 aa, Homo sapiens
AVQNLQAKE

SEQ ID NO: 5279 - protein, 9 aa, Homo sapiens
RESMELLDS

SEQ ID NO: 5280 - protein, 9 aa, Homo sapiens
YGLTIKPKS

SEQ ID NO: 5281 - protein, 9 aa, Homo sapiens
CDFRANPNE

SEQ ID NO: 5282 - protein, 9 aa, Homo sapiens
GKRRCIGEE

SEQ ID NO: 5283 - protein, 9 aa, Homo sapiens
VVFVNQWSV

SEQ ID NO: 5284 - protein, 9 aa, Homo sapiens
VTIPHATTA

SEQ ID NO: 5285 - protein, 9 aa, Homo sapiens
SSFVPVTIP

SEQ ID NO: 5286 - protein, 9 aa, Homo sapiens
RFSSFVPVT

SEQ ID NO: 5287 - protein, 9 aa, Homo sapiens
RDRLPCMGD

SEQ ID NO: 5288 - protein, 9 aa, Homo sapiens
RVQAELDQV

SEQ ID NO: 5289 - protein, 9 aa, Homo sapiens
GASQDTLST

SEQ ID NO: 5290 - protein, 9 aa, Homo sapiens
TDIFGASQD

SEQ ID NO: 5291 - protein, 9 aa, Homo sapiens
GARLDLENV

SEQ ID NO: 5292 - protein, 9 aa, Homo sapiens
GGARLDLEN

SEQ ID NO: 5293 - protein, 9 aa, Homo sapiens
RHCESLRPG

SEQ ID NO: 5294 - protein, 9 aa, Homo sapiens
QYFPNPVRT

SEQ ID NO: 5295 - protein, 9 aa, Homo sapiens
PWLQYFPNP

SEQ ID NO: 5296 - protein, 9 aa, Homo sapiens
GSLVDVMPW

SEQ ID NO: 5297 - protein, 9 aa, Homo sapiens
EHWKVQRRA

SEQ ID NO: 5298 - protein, 9 aa, Homo sapiens
ASFRVVSGG

SEQ ID NO: 5299 - protein, 9 aa, Homo sapiens
RPAFASFRV

SEQ ID NO: 5300 - protein, 9 aa, Homo sapiens
GSCPIVVLN

SEQ ID NO: 5301 - protein, 9 aa, Homo sapiens
DVFQIRLGS

SEQ ID NO: 5302 - protein, 9 aa, Homo sapiens
GDVFQIRLG

SEQ ID NO: 5303 - protein, 9 aa, Homo sapiens
FAWPLIGNA

SEQ ID NO: 5304 - protein, 9 aa, Homo sapiens
GPFAWPLIG

SEQ ID NO: 5305 - protein, 9 aa, Homo sapiens
PGPFAWPLI

SEQ ID NO: 5306 - protein, 9 aa, Homo sapiens
RSAPPGPFA

SEQ ID NO: 5307 - protein, 9 aa, Homo sapiens
TTLLLLLSV

SEQ ID NO: 5308 - protein, 9 aa, Homo sapiens
QNLQAKETC

SEQ ID NO: 5309 - protein, 9 aa, Homo sapiens
ELLDSAVQN

SEQ ID NO: 5310 - protein, 9 aa, Homo sapiens
MELLDSAVQ

SEQ ID NO: 5311 - protein, 9 aa, Homo sapiens
KPKSFKVNV

SEQ ID NO: 5312 - protein, 9 aa, Homo sapiens
IFSVGKRRC

SEQ ID NO: 5313 - protein, 9 aa, Homo sapiens
KDTVVFVNQ

SEQ ID NO: 5314 - protein, 9 aa, Homo sapiens
GYHIPKDTV

SEQ ID NO: 5315 - protein, 9 aa, Homo sapiens
VLGYHIPKD

SEQ ID NO: 5316 - protein, 9 aa, Homo sapiens
GDQPNLPYV

SEQ ID NO: 5317 - protein, 9 aa, Homo sapiens
ELDQVVGRD

SEQ ID NO: 5318 - protein, 9 aa, Homo sapiens
DIFGASQDT

SEQ ID NO: 5319 - protein, 9 aa, Homo sapiens
ATITDIFGA

SEQ ID NO: 5320 - protein, 9 aa, Homo sapiens
KKAAGDSHG

SEQ ID NO: 5321 - protein, 9 aa, Homo sapiens
GAAPRDMMD

SEQ ID NO: 5322 - protein, 9 aa, Homo sapiens
RTVFREFEQ

SEQ ID NO: 5323 - protein, 9 aa, Homo sapiens
EEFGRTVGA

SEQ ID NO: 5324 - protein, 9 aa, Homo sapiens
GSADGAFLD

SEQ ID NO: 5325 - protein, 9 aa, Homo sapiens
ELVALLVRG

SEQ ID NO: 5326 - protein, 9 aa, Homo sapiens
QVLEGHVLS

SEQ ID NO: 5327 - protein, 9 aa, Homo sapiens
FTRQPRSRQ

SEQ ID NO: 5328 - protein, 9 aa, Homo sapiens
LVQQGSAFA

SEQ ID NO: 5329 - protein, 9 aa, Homo sapiens
AIHQALVQQ

SEQ ID NO: 5330 - protein, 9 aa, Homo sapiens
RLGSCPIVV

SEQ ID NO: 5331 - protein, 9 aa, Homo sapiens
PLIGNAAAV

SEQ ID NO: 5332 - protein, 9 aa, Homo sapiens
WPLIGNAAA

SEQ ID NO: 5333 - protein, 9 aa, Homo sapiens
HVGQRLLRQ

SEQ ID NO: 5334 - protein, 9 aa, Homo sapiens
LLLSVLATV

SEQ ID NO: 5335 - protein, 9 aa, Homo sapiens
LLLLSVLAT

SEQ ID NO: 5336 - protein, 9 aa, Homo sapiens
LLLLLSVLA

SEQ ID NO: 5337 - protein, 9 aa, Homo sapiens
NPLSIQQTT

SEQ ID NO: 5338 - protein, 9 aa, Homo sapiens
LNPLSIQQT

SEQ ID NO: 5339 - protein, 9 aa, Homo sapiens
GTSLSPNDP

SEQ ID NO: 5340 - protein, 9 aa, Homo sapiens
FKVNVTLRE

SEQ ID NO: 5341 - protein, 9 aa, Homo sapiens
IKPKSFKVN

SEQ ID NO: 5342 - protein, 9 aa, Homo sapiens
TIKPKSFKV

SEQ ID NO: 5343 - protein, 9 aa, Homo sapiens
LAHQCDFRA

SEQ ID NO: 5344 - protein, 9 aa, Homo sapiens
LFISILAHQ

SEQ ID NO: 5345 - protein, 9 aa, Homo sapiens
LFLFISILA

SEQ ID NO: 5346 - protein, 9 aa, Homo sapiens
INKDLTSRV

SEQ ID NO: 5347 - protein, 9 aa, Homo sapiens
DPLKWPNPE

SEQ ID NO: 5348 - protein, 9 aa, Homo sapiens
HDPLKWPNP

SEQ ID NO: 5349 - protein, 9 aa, Homo sapiens
YVLAFLYEA

SEQ ID NO: 5350 - protein, 9 aa, Homo sapiens
RLPCMGDQP

SEQ ID NO: 5351 - protein, 9 aa, Homo sapiens
QAELDQVVG

SEQ ID NO: 5352 - protein, 9 aa, Homo sapiens
PDVQTRVQA

SEQ ID NO: 5353 - protein, 9 aa, Homo sapiens
DTLSTALQW

SEQ ID NO: 5354 - protein, 9 aa, Homo sapiens
LDLENVPAT

SEQ ID NO: 5355 - protein, 9 aa, Homo sapiens
SHGGGARLD

SEQ ID NO: 5356 - protein, 9 aa, Homo sapiens
KAAGDSHGG

SEQ ID NO: 5357 - protein, 9 aa, Homo sapiens
SAEKKAAGD

SEQ ID NO: 5358 - protein, 9 aa, Homo sapiens
MMDAFILSA

SEQ ID NO: 5359 - protein, 9 aa, Homo sapiens
DKFLRHCES

SEQ ID NO: 5360 - protein, 9 aa, Homo sapiens
AGSLVDVMP

SEQ ID NO: 5361 - protein, 9 aa, Homo sapiens
VGAGSLVDV

SEQ ID NO: 5362 - protein, 9 aa, Homo sapiens
TVGAGSLVD

SEQ ID NO: 5363 - protein, 9 aa, Homo sapiens
NEEFGRTVG

SEQ ID NO: 5364 - protein, 9 aa, Homo sapiens
LTVVAVANV

SEQ ID NO: 5365 - protein, 9 aa, Homo sapiens
LDPRPLTVV

SEQ ID NO: 5366 - protein, 9 aa, Homo sapiens
AFLDPRPLT

SEQ ID NO: 5367 - protein, 9 aa, Homo sapiens
DGAFLDPRP

SEQ ID NO: 5368 - protein, 9 aa, Homo sapiens
LLVRGSADG

SEQ ID NO: 5369 - protein, 9 aa, Homo sapiens
VALLVRGSA

SEQ ID NO: 5370 - protein, 9 aa, Homo sapiens
VLEGHVLSE

SEQ ID NO: 5371 - protein, 9 aa, Homo sapiens
VVSGGRSMA

SEQ ID NO: 5372 - protein, 9 aa, Homo sapiens
PAFASFRVV

SEQ ID NO: 5373 - protein, 9 aa, Homo sapiens
QALVQQGSA

SEQ ID NO: 5374 - protein, 9 aa, Homo sapiens
IVVLNGERA

SEQ ID NO: 5375 - protein, 9 aa, Homo sapiens
CPIVVLNGE

SEQ ID NO: 5376 - protein, 9 aa, Homo sapiens
SCPIVVLNG

SEQ ID NO: 5377 - protein, 9 aa, Homo sapiens
GQAAHLSFA

SEQ ID NO: 5378 - protein, 9 aa, Homo sapiens
GNAAAVGQA

SEQ ID NO: 5379 - protein, 9 aa, Homo sapiens
APPGPFAWP

SEQ ID NO: 5380 - protein, 9 aa, Homo sapiens
PLNPLSIQQ

SEQ ID NO: 5381 - protein, 9 aa, Homo sapiens
WPLNPLSIQ

SEQ ID NO: 5382 - protein, 9 aa, Homo sapiens
MGTSLSPND

SEQ ID NO: 5383 - protein, 9 aa, Homo sapiens
LDSAVQNLQ

SEQ ID NO: 5384 - protein, 9 aa, Homo sapiens
SMELLDSAV

SEQ ID NO: 5385 - protein, 9 aa, Homo sapiens
ESMELLDSA

SEQ ID NO: 5386 - protein, 9 aa, Homo sapiens
KVNVTLRES

SEQ ID NO: 5387 - protein, 9 aa, Homo sapiens
PKSFKVNVT

SEQ ID NO: 5388 - protein, 9 aa, Homo sapiens
ISILAHQCD

SEQ ID NO: 5389 - protein, 9 aa, Homo sapiens
KMQLFLFIS

SEQ ID NO: 5390 - protein, 9 aa, Homo sapiens
IGEELSKMQ

SEQ ID NO: 5391 - protein, 9 aa, Homo sapiens
TSRVMIFSV

SEQ ID NO: 5392 - protein, 9 aa, Homo sapiens
KWPNPENFD

SEQ ID NO: 5393 - protein, 9 aa, Homo sapiens
PLKWPNPEN

SEQ ID NO: 5394 - protein, 9 aa, Homo sapiens
NHDPLKWPN

SEQ ID NO: 5395 - protein, 9 aa, Homo sapiens
DTVVFVNQW

SEQ ID NO: 5396 - protein, 9 aa, Homo sapiens
TSVLGYHIP

SEQ ID NO: 5397 - protein, 9 aa, Homo sapiens
HATTANTSV

SEQ ID NO: 5398 - protein, 9 aa, Homo sapiens
IPHATTANT

SEQ ID NO: 5399 - protein, 9 aa, Homo sapiens
FVPVTIPHA

SEQ ID NO: 5400 - protein, 9 aa, Homo sapiens
AMRFSSFVP

SEQ ID NO: 5401 - protein, 9 aa, Homo sapiens
QVVGRDRLP

SEQ ID NO: 5402 - protein, 9 aa, Homo sapiens
VQAELDQVV

SEQ ID NO: 5403 - protein, 9 aa, Homo sapiens
FTRYPDVQT

SEQ ID NO: 5404 - protein, 9 aa, Homo sapiens
LLFTRYPDV

SEQ ID NO: 5405 - protein, 9 aa, Homo sapiens
LQWLLLLFT

SEQ ID NO: 5406 - protein, 9 aa, Homo sapiens
ASQDTLSTA

SEQ ID NO: 5407 - protein, 9 aa, Homo sapiens
ENVPATITD

SEQ ID NO: 5408 - protein, 9 aa, Homo sapiens
LENVPATIT

SEQ ID NO: 5409 - protein, 9 aa, Homo sapiens
GGGARLDLE

SEQ ID NO: 5410 - protein, 9 aa, Homo sapiens
AEKKAAGDS

SEQ ID NO: 5411 - protein, 9 aa, Homo sapiens
LSAEKKAAG

SEQ ID NO: 5412 - protein, 9 aa, Homo sapiens
FILSAEKKA

SEQ ID NO: 5413 - protein, 9 aa, Homo sapiens
ESLRPGAAP

SEQ ID NO: 5414 - protein, 9 aa, Homo sapiens
ILDKFLRHC

SEQ ID NO: 5415 - protein, 9 aa, Homo sapiens
EQLNRNFSN

SEQ ID NO: 5416 - protein, 9 aa, Homo sapiens
NPVRTVFRE

SEQ ID NO: 5417 - protein, 9 aa, Homo sapiens
VMPWLQYFP

SEQ ID NO: 5418 - protein, 9 aa, Homo sapiens
SHNEEFGRT

SEQ ID NO: 5419 - protein, 9 aa, Homo sapiens
EFRELLSHN

SEQ ID NO: 5420 - protein, 9 aa, Homo sapiens
GCRYSHDDP

SEQ ID NO: 5421 - protein, 9 aa, Homo sapiens
VAVANVMSA

SEQ ID NO: 5422 - protein, 9 aa, Homo sapiens
DPRPLTVVA

SEQ ID NO: 5423 - protein, 9 aa, Homo sapiens
LVRGSADGA

SEQ ID NO: 5424 - protein, 9 aa, Homo sapiens
ALLVRGSAD

SEQ ID NO: 5425 - protein, 9 aa, Homo sapiens
LEGHVLSEA

SEQ ID NO: 5426 - protein, 9 aa, Homo sapiens
MMRNFFTRQ

SEQ ID NO: 5427 - protein, 9 aa, Homo sapiens
KVQRRAAHS

SEQ ID NO: 5428 - protein, 9 aa, Homo sapiens
SMAFGHYSE

SEQ ID NO: 5429 - protein, 9 aa, Homo sapiens
RSMAFGHYS

SEQ ID NO: 5430 - protein, 9 aa, Homo sapiens
GSAFADRPA

SEQ ID NO: 5431 - protein, 9 aa, Homo sapiens
VQQGSAFAD

SEQ ID NO: 5432 - protein, 9 aa, Homo sapiens
HQALVQQGS

SEQ ID NO: 5433 - protein, 9 aa, Homo sapiens
IHQALVQQG

SEQ ID NO: 5434 - protein, 9 aa, Homo sapiens
NGERAIHQA

SEQ ID NO: 5435 - protein, 9 aa, Homo sapiens
FQIRLGSCP

SEQ ID NO: 5436 - protein, 9 aa, Homo sapiens
RLARRYGDV

SEQ ID NO: 5437 - protein, 9 aa, Homo sapiens
AHLSFARLA

SEQ ID NO: 5438 - protein, 9 aa, Homo sapiens
AVGQAAHLS

SEQ ID NO: 5439 - protein, 9 aa, Homo sapiens
AWPLIGNAA

SEQ ID NO: 5440 - protein, 9 aa, Homo sapiens
SVLATVHVG

SEQ ID NO: 5441 - protein, 9 aa, Homo sapiens
QTTLLLLLS

SEQ ID NO: 5442 - protein, 9 aa, Homo sapiens
DPWPLNPLS

SEQ ID NO: 5443 - protein, 9 aa, Homo sapiens
PNDPWPLNP

SEQ ID NO: 5444 - protein, 9 aa, Homo sapiens
TSLSPNDPW

SEQ ID NO: 5445 - protein, 9 aa, Homo sapiens
NLQAKETCQ

SEQ ID NO: 5446 - protein, 9 aa, Homo sapiens
VQNLQAKET

SEQ ID NO: 5447 - protein, 9 aa, Homo sapiens
DSAVQNLQA

SEQ ID NO: 5448 - protein, 9 aa, Homo sapiens
KMNFSYGLT

SEQ ID NO: 5449 - protein, 9 aa, Homo sapiens
NPNEPAKMN

SEQ ID NO: 5450 - protein, 9 aa, Homo sapiens
HQCDFRANP

SEQ ID NO: 5451 - protein, 9 aa, Homo sapiens
FISILAHQC

SEQ ID NO: 5452 - protein, 9 aa, Homo sapiens
DGLINKDLT

SEQ ID NO: 5453 - protein, 9 aa, Homo sapiens
FLDKDGLIN

SEQ ID NO: 5454 - protein, 9 aa, Homo sapiens
DPARFLDKD

SEQ ID NO: 5455 - protein, 9 aa, Homo sapiens
WPNPENFDP

SEQ ID NO: 5456 - protein, 9 aa, Homo sapiens
SVNHDPLKW

SEQ ID NO: 5457 - protein, 9 aa, Homo sapiens
VNQWSVNHD

SEQ ID NO: 5458 - protein, 9 aa, Homo sapiens
VFVNQWSVN

SEQ ID NO: 5459 - protein, 9 aa, Homo sapiens
TVVFVNQWS

SEQ ID NO: 5460 - protein, 9 aa, Homo sapiens
PKDTVVFVN

SEQ ID NO: 5461 - protein, 9 aa, Homo sapiens
IPKDTVVFV

SEQ ID NO: 5462 - protein, 9 aa, Homo sapiens
LGYHIPKDT

SEQ ID NO: 5463 - protein, 9 aa, Homo sapiens
PHATTANTS

SEQ ID NO: 5464 - protein, 9 aa, Homo sapiens
PVTIPHATT

SEQ ID NO: 5465 - protein, 9 aa, Homo sapiens
FLYEAMRFS

SEQ ID NO: 5466 - protein, 9 aa, Homo sapiens
PYVLAFLYE

SEQ ID NO: 5467 - protein, 9 aa, Homo sapiens
QPNLPYVLA

SEQ ID NO: 5468 - protein, 9 aa, Homo sapiens
LPCMGDQPN

SEQ ID NO: 5469 - protein, 9 aa, Homo sapiens
LLLFTRYPD

SEQ ID NO: 5470 - protein, 9 aa, Homo sapiens
LLLLFTRYP

SEQ ID NO: 5471 - protein, 9 aa, Homo sapiens
QDTLSTALQ

SEQ ID NO: 5472 - protein, 9 aa, Homo sapiens
FGASQDTLS

SEQ ID NO: 5473 - protein, 9 aa, Homo sapiens
ITDIFGASQ

SEQ ID NO: 5474 - protein, 9 aa, Homo sapiens
ILSAEKKAA

SEQ ID NO: 5475 - protein, 9 aa, Homo sapiens
MDAFILSAE

SEQ ID NO: 5476 - protein, 9 aa, Homo sapiens
YFPNPVRTV

SEQ ID NO: 5477 - protein, 9 aa, Homo sapiens
SHDDPEFRE

SEQ ID NO: 5478 - protein, 9 aa, Homo sapiens
AVCFGCRYS

SEQ ID NO: 5479 - protein, 9 aa, Homo sapiens
VANVMSAVC

SEQ ID NO: 5480 - protein, 9 aa, Homo sapiens
AVANVMSAV

SEQ ID NO: 5481 - protein, 9 aa, Homo sapiens
PLTVVAVAN

SEQ ID NO: 5482 - protein, 9 aa, Homo sapiens
FLDPRPLTV

SEQ ID NO: 5483 - protein, 9 aa, Homo sapiens
SADGAFLDP

SEQ ID NO: 5484 - protein, 9 aa, Homo sapiens
LVALLVRGS

SEQ ID NO: 5485 - protein, 9 aa, Homo sapiens
QPRSRQVLE

SEQ ID NO: 5486 - protein, 9 aa, Homo sapiens
FASFRVVSG

SEQ ID NO: 5487 - protein, 9 aa, Homo sapiens
AFASFRVVS

SEQ ID NO: 5488 - protein, 9 aa, Homo sapiens
QGSAFADRP

SEQ ID NO: 5489 - protein, 9 aa, Homo sapiens
LNGERAIHQ

SEQ ID NO: 5490 - protein, 9 aa, Homo sapiens
IGNAAAVGQ

SEQ ID NO: 5491 - protein, 9 aa, Homo sapiens
LIGNAAAVG

SEQ ID NO: 5492 - protein, 9 aa, Homo sapiens
PFAWPLIGN

SEQ ID NO: 5493 - protein, 9 aa, Homo sapiens
SAPPGPFAW

SEQ ID NO: 5494 - protein, 9 aa, Homo sapiens
LSVLATVHV

SEQ ID NO: 5495 - protein, 9 aa, Homo sapiens
SLSPNDPWP

SEQ ID NO: 5496 - protein, 9 aa, Homo sapiens
NVTLRESME

SEQ ID NO: 5497 - protein, 9 aa, Homo sapiens
NEPAKMNFS

SEQ ID NO: 5498 - protein, 9 aa, Homo sapiens
DFRANPNEP

SEQ ID NO: 5499 - protein, 9 aa, Homo sapiens
QCDFRANPN

SEQ ID NO: 5500 - protein, 9 aa, Homo sapiens
SVGKRRCIG

SEQ ID NO: 5501 - protein, 9 aa, Homo sapiens
LTSRVMIFS

SEQ ID NO: 5502 - protein, 9 aa, Homo sapiens
PARFLDKDG

SEQ ID NO: 5503 - protein, 9 aa, Homo sapiens
VNHDPLKWP

SEQ ID NO: 5504 - protein, 9 aa, Homo sapiens
NQWSVNHDP

SEQ ID NO: 5505 - protein, 9 aa, Homo sapiens
TTANTSVLG

SEQ ID NO: 5506 - protein, 9 aa, Homo sapiens
TIPHATTAN

SEQ ID NO: 5507 - protein, 9 aa, Homo sapiens
VPVTIPHAT

SEQ ID NO: 5508 - protein, 9 aa, Homo sapiens
EAMRFSSFV

SEQ ID NO: 5509 - protein, 9 aa, Homo sapiens
PATITDIFG

SEQ ID NO: 5510 - protein, 9 aa, Homo sapiens
AAGDSHGGG

SEQ ID NO: 5511 - protein, 9 aa, Homo sapiens
AAPRDMMDA

SEQ ID NO: 5512 - protein, 9 aa, Homo sapiens
HCESLRPGA

SEQ ID NO: 5513 - protein, 9 aa, Homo sapiens
FEQLNRNFS

SEQ ID NO: 5514 - protein, 9 aa, Homo sapiens
FGRTVGAGS

SEQ ID NO: 5515 - protein, 9 aa, Homo sapiens
HNEEFGRTV

SEQ ID NO: 5516 - protein, 9 aa, Homo sapiens
VVAVANVMS

SEQ ID NO: 5517 - protein, 9 aa, Homo sapiens
LSEARELVA

SEQ ID NO: 5518 - protein, 9 aa, Homo sapiens
HYSEHWKVQ

SEQ ID NO: 5519 - protein, 9 aa, Homo sapiens
AFGHYSEHW

SEQ ID NO: 5520 - protein, 9 aa, Homo sapiens
SGGRSMAFG

SEQ ID NO: 5521 - protein, 9 aa, Homo sapiens
FADRPAFAS

SEQ ID NO: 5522 - protein, 9 aa, Homo sapiens
AFADRPAFA

SEQ ID NO: 5523 - protein, 9 aa, Homo sapiens
VFQIRLGSC

SEQ ID NO: 5524 - protein, 9 aa, Homo sapiens
VLATVHVGQ

SEQ ID NO: 5525 - protein, 9 aa, Homo sapiens
SPNDPWPLN

SEQ ID NO: 5526 - protein, 9 aa, Homo sapiens
PAKMNFSYG

SEQ ID NO: 5527 - protein, 9 aa, Homo sapiens
AHQCDFRAN

SEQ ID NO: 5528 - protein, 9 aa, Homo sapiens
VGKRRCIGE

SEQ ID NO: 5529 - protein, 9 aa, Homo sapiens
NFDPARFLD

SEQ ID NO: 5530 - protein, 9 aa, Homo sapiens
PNPENFDPA

SEQ ID NO: 5531 - protein, 9 aa, Homo sapiens
LYEAMRFSS

SEQ ID NO: 5532 - protein, 9 aa, Homo sapiens
CMGDQPNLP

SEQ ID NO: 5533 - protein, 9 aa, Homo sapiens
VVGRDRLPC

SEQ ID NO: 5534 - protein, 9 aa, Homo sapiens
QTRVQAELD

SEQ ID NO: 5535 - protein, 9 aa, Homo sapiens
DVQTRVQAE

SEQ ID NO: 5536 - protein, 9 aa, Homo sapiens
YPDVQTRVQ

SEQ ID NO: 5537 - protein, 9 aa, Homo sapiens
LFTRYPDVQ

SEQ ID NO: 5538 - protein, 9 aa, Homo sapiens
TITDIFGAS

SEQ ID NO: 5539 - protein, 9 aa, Homo sapiens
AGDSHGGGA

SEQ ID NO: 5540 - protein, 9 aa, Homo sapiens
DMMDAFILS

SEQ ID NO: 5541 - protein, 9 aa, Homo sapiens
CESLRPGAA

SEQ ID NO: 5542 - protein, 9 aa, Homo sapiens
LDKFLRHCE

SEQ ID NO: 5543 - protein, 9 aa, Homo sapiens
VFREFEQLN

SEQ ID NO: 5544 - protein, 9 aa, Homo sapiens
WLQYFPNPV

SEQ ID NO: 5545 - protein, 9 aa, Homo sapiens
MPWLQYFPN

SEQ ID NO: 5546 - protein, 9 aa, Homo sapiens
LVDVMPWLQ

SEQ ID NO: 5547 - protein, 9 aa, Homo sapiens
EFGRTVGAG

SEQ ID NO: 5548 - protein, 9 aa, Homo sapiens
DPEFRELLS

SEQ ID NO: 5549 - protein, 9 aa, Homo sapiens
FGCRYSHDD

SEQ ID NO: 5550 - protein, 9 aa, Homo sapiens
CFGCRYSHD

SEQ ID NO: 5551 - protein, 9 aa, Homo sapiens
VMSAVCFGC

SEQ ID NO: 5552 - protein, 9 aa, Homo sapiens
NVMSAVCFG

SEQ ID NO: 5553 - protein, 9 aa, Homo sapiens
VLSEARELV

SEQ ID NO: 5554 - protein, 9 aa, Homo sapiens
HSMMRNFFT

SEQ ID NO: 5555 - protein, 9 aa, Homo sapiens
FARLARRYG

SEQ ID NO: 5556 - protein, 9 aa, Homo sapiens
NAAAVGQAA

SEQ ID NO: 5557 - protein, 9 aa, Homo sapiens
QLRSAPPGP

SEQ ID NO: 5558 - protein, 8 aa, Homo sapiens
QPRSRQVL

SEQ ID NO: 5559 - protein, 8 aa, Homo sapiens
TLRESMEL

SEQ ID NO: 5560 - protein, 8 aa, Homo sapiens
TIKPKSFK

SEQ ID NO: 5561 - protein, 8 aa, Homo sapiens
DPEFRELL

SEQ ID NO: 5562 - protein, 8 aa, Homo sapiens
EARELVAL

SEQ ID NO: 5563 - protein, 8 aa, Homo sapiens
SFKVNVTL

SEQ ID NO: 5564 - protein, 8 aa, Homo sapiens
IPKDTVVF

SEQ ID NO: 5565 - protein, 8 aa, Homo sapiens
FLRHCESL

SEQ ID NO: 5566 - protein, 8 aa, Homo sapiens
EELSKMQL

SEQ ID NO: 5567 - protein, 8 aa, Homo sapiens
LSKMQLFL

SEQ ID NO: 5568 - protein, 8 aa, Homo sapiens
DLTSRVMI

SEQ ID NO: 5569 - protein, 8 aa, Homo sapiens
RFLDKDGL

SEQ ID NO: 5570 - protein, 8 aa, Homo sapiens
LLRQRRRQ

SEQ ID NO: 5571 - protein, 8 aa, Homo sapiens
VGKRRCIG

SEQ ID NO: 5572 - protein, 8 aa, Homo sapiens
GGGARLDL

SEQ ID NO: 5573 - protein, 8 aa, Homo sapiens
VFREFEQL

SEQ ID NO: 5574 - protein, 8 aa, Homo sapiens
VLSEAREL

SEQ ID NO: 5575 - protein, 8 aa, Homo sapiens
QVVGRDRL

SEQ ID NO: 5576 - protein, 8 aa, Homo sapiens
LRQRRRQL

SEQ ID NO: 5577 - protein, 8 aa, Homo sapiens
SPNDPWPL

SEQ ID NO: 5578 - protein, 8 aa, Homo sapiens
GLTIKPKS

SEQ ID NO: 5579 - protein, 8 aa, Homo sapiens
GLINKDLT

SEQ ID NO: 5580 - protein, 8 aa, Homo sapiens
LPYVLAFL

SEQ ID NO: 5581 - protein, 8 aa, Homo sapiens
QPNLPYVL

SEQ ID NO: 5582 - protein, 8 aa, Homo sapiens
QTRVQAEL

SEQ ID NO: 5583 - protein, 8 aa, Homo sapiens
LLLLLSVL

SEQ ID NO: 5584 - protein, 8 aa, Homo sapiens
NLQAKETC

SEQ ID NO: 5585 - protein, 8 aa, Homo sapiens
KPKSFKVN

SEQ ID NO: 5586 - protein, 8 aa, Homo sapiens
NEPAKMNF

SEQ ID NO: 5587 - protein, 8 aa, Homo sapiens
SVGKRRCI

SEQ ID NO: 5588 - protein, 8 aa, Homo sapiens
PLKWPNPE

SEQ ID NO: 5589 - protein, 8 aa, Homo sapiens
ALQWLLLL

SEQ ID NO: 5590 - protein, 8 aa, Homo sapiens
SAEKKAAG

SEQ ID NO: 5591 - protein, 8 aa, Homo sapiens
SIQQTTLL

SEQ ID NO: 5592 - protein, 8 aa, Homo sapiens
DPWPLNPL

SEQ ID NO: 5593 - protein, 8 aa, Homo sapiens
FLYEAMRF

SEQ ID NO: 5594 - protein, 8 aa, Homo sapiens
VGRDRLPC

SEQ ID NO: 5595 - protein, 8 aa, Homo sapiens
FILDKFLR

SEQ ID NO: 5596 - protein, 8 aa, Homo sapiens
PNPVRTVF

SEQ ID NO: 5597 - protein, 8 aa, Homo sapiens
FLDPRPLT

SEQ ID NO: 5598 - protein, 8 aa, Homo sapiens
ALLVRGSA

SEQ ID NO: 5599 - protein, 8 aa, Homo sapiens
HSMMRNFF

SEQ ID NO: 5600 - protein, 8 aa, Homo sapiens
PAKMNFSY

SEQ ID NO: 5601 - protein, 8 aa, Homo sapiens
ELSKMQLF

SEQ ID NO: 5602 - protein, 8 aa, Homo sapiens
LLFTRYPD

SEQ ID NO: 5603 - protein, 8 aa, Homo sapiens
TALQWLLL

SEQ ID NO: 5604 - protein, 8 aa, Homo sapiens
SLRPGAAP

SEQ ID NO: 5605 - protein, 8 aa, Homo sapiens
AFADRPAF

SEQ ID NO: 5606 - protein, 8 aa, Homo sapiens
RLARRYGD

SEQ ID NO: 5607 - protein, 8 aa, Homo sapiens
RQRRRQLR

SEQ ID NO: 5608 - protein, 8 aa, Homo sapiens
ILAHQCDF

SEQ ID NO: 5609 - protein, 8 aa, Homo sapiens
QLFLFISI

SEQ ID NO: 5610 - protein, 8 aa, Homo sapiens
FLDKDGLI

SEQ ID NO: 5611 - protein, 8 aa, Homo sapiens
NLPYVLAF

SEQ ID NO: 5612 - protein, 8 aa, Homo sapiens
STALQWLL

SEQ ID NO: 5613 - protein, 8 aa, Homo sapiens
VPATITDI

SEQ ID NO: 5614 - protein, 8 aa, Homo sapiens
GAAPRDMM

SEQ ID NO: 5615 - protein, 8 aa, Homo sapiens
FASFRVVS

SEQ ID NO: 5616 - protein, 8 aa, Homo sapiens
VLNGERAI

SEQ ID NO: 5617 - protein, 8 aa, Homo sapiens
ARRYGDVF

SEQ ID NO: 5618 - protein, 8 aa, Homo sapiens
GPFAWPLI

SEQ ID NO: 5619 - protein, 8 aa, Homo sapiens
HDPLKWPN

SEQ ID NO: 5620 - protein, 8 aa, Homo sapiens
EAMRFSSF

SEQ ID NO: 5621 - protein, 8 aa, Homo sapiens
GARLDLEN

SEQ ID NO: 5622 - protein, 8 aa, Homo sapiens
SHGGGARL

SEQ ID NO: 5623 - protein, 8 aa, Homo sapiens
EKKAAGDS

SEQ ID NO: 5624 - protein, 8 aa, Homo sapiens
LSAEKKAA

SEQ ID NO: 5625 - protein, 8 aa, Homo sapiens
APRDMMDA

SEQ ID NO: 5626 - protein, 8 aa, Homo sapiens
LNRNFSNF

SEQ ID NO: 5627 - protein, 8 aa, Homo sapiens
LLSHNEEF

SEQ ID NO: 5628 - protein, 8 aa, Homo sapiens
DDPEFREL

SEQ ID NO: 5629 - protein, 8 aa, Homo sapiens
DPRPLTVV

SEQ ID NO: 5630 - protein, 8 aa, Homo sapiens
QVLEGHVL

SEQ ID NO: 5631 - protein, 8 aa, Homo sapiens
HWKVQRRA

SEQ ID NO: 5632 - protein, 8 aa, Homo sapiens
SEHWKVQR

SEQ ID NO: 5633 - protein, 8 aa, Homo sapiens
ERAIHQAL

SEQ ID NO: 5634 - protein, 8 aa, Homo sapiens
FARLARRY

SEQ ID NO: 5635 - protein, 8 aa, Homo sapiens
QLRSAPPG

SEQ ID NO: 5636 - protein, 8 aa, Homo sapiens
WPLNPLSI

SEQ ID NO: 5637 - protein, 8 aa, Homo sapiens
FSVGKRRC

SEQ ID NO: 5638 - protein, 8 aa, Homo sapiens
INKDLTSR

SEQ ID NO: 5639 - protein, 8 aa, Homo sapiens
QDTLSTAL

SEQ ID NO: 5640 - protein, 8 aa, Homo sapiens
FGASQDTL

SEQ ID NO: 5641 - protein, 8 aa, Homo sapiens
NFILDKFL

SEQ ID NO: 5642 - protein, 8 aa, Homo sapiens
LVDVMPWL

SEQ ID NO: 5643 - protein, 8 aa, Homo sapiens
GSADGAFL

SEQ ID NO: 5644 - protein, 8 aa, Homo sapiens
ARELVALL

SEQ ID NO: 5645 - protein, 8 aa, Homo sapiens
GSCPIVVL

SEQ ID NO: 5646 - protein, 8 aa, Homo sapiens
QIRLGSCP

SEQ ID NO: 5647 - protein, 8 aa, Homo sapiens
GDVFQIRL

SEQ ID NO: 5648 - protein, 8 aa, Homo sapiens
VHVGQRLL

SEQ ID NO: 5649 - protein, 8 aa, Homo sapiens
TVHVGQRL

SEQ ID NO: 5650 - protein, 8 aa, Homo sapiens
QTTLLLLL

SEQ ID NO: 5651 - protein, 8 aa, Homo sapiens
IQQTTLLL

SEQ ID NO: 5652 - protein, 8 aa, Homo sapiens
LDSAVQNL

SEQ ID NO: 5653 - protein, 8 aa, Homo sapiens
LRESMELL

SEQ ID NO: 5654 - protein, 8 aa, Homo sapiens
PKSFKVNV

SEQ ID NO: 5655 - protein, 8 aa, Homo sapiens
KMNFSYGL

SEQ ID NO: 5656 - protein, 8 aa, Homo sapiens
LFLFISIL

SEQ ID NO: 5657 - protein, 8 aa, Homo sapiens
RRCIGEEL

SEQ ID NO: 5658 - protein, 8 aa, Homo sapiens
DGLINKDL

SEQ ID NO: 5659 - protein, 8 aa, Homo sapiens
LDKDGLIN

SEQ ID NO: 5660 - protein, 8 aa, Homo sapiens
PARFLDKD

SEQ ID NO: 5661 - protein, 8 aa, Homo sapiens
NFDPARFL

SEQ ID NO: 5662 - protein, 8 aa, Homo sapiens
WSVNHDPL

SEQ ID NO: 5663 - protein, 8 aa, Homo sapiens
YHIPKDTV

SEQ ID NO: 5664 - protein, 8 aa, Homo sapiens
TTANTSVL

SEQ ID NO: 5665 - protein, 8 aa, Homo sapiens
CMGDQPNL

SEQ ID NO: 5666 - protein, 8 aa, Homo sapiens
LSTALQWL

SEQ ID NO: 5667 - protein, 8 aa, Homo sapiens
PATITDIF

SEQ ID NO: 5668 - protein, 8 aa, Homo sapiens
AEKKAAGD

SEQ ID NO: 5669 - protein, 8 aa, Homo sapiens
DMMDAFIL

SEQ ID NO: 5670 - protein, 8 aa, Homo sapiens
LDKFLRHC

SEQ ID NO: 5671 - protein, 8 aa, Homo sapiens
RNFSNFIL

SEQ ID NO: 5672 - protein, 8 aa, Homo sapiens
EQLNRNFS

SEQ ID NO: 5673 - protein, 8 aa, Homo sapiens
RTVGAGSL

SEQ ID NO: 5674 - protein, 8 aa, Homo sapiens
EEFGRTVG

SEQ ID NO: 5675 - protein, 8 aa, Homo sapiens
EFRELLSH

SEQ ID NO: 5676 - protein, 8 aa, Homo sapiens
AFLDPRPL

SEQ ID NO: 5677 - protein, 8 aa, Homo sapiens
LNGERAIH

SEQ ID NO: 5678 - protein, 8 aa, Homo sapiens
LARRYGDV

SEQ ID NO: 5679 - protein, 8 aa, Homo sapiens
AHLSFARL

SEQ ID NO: 5680 - protein, 8 aa, Homo sapiens
AVGQAAHL

SEQ ID NO: 5681 - protein, 8 aa, Homo sapiens
PGPFAWPL

SEQ ID NO: 5682 - protein, 8 aa, Homo sapiens
QQTTLLLL

SEQ ID NO: 5683 - protein, 8 aa, Homo sapiens
LSIQQTTL

SEQ ID NO: 5684 - protein, 8 aa, Homo sapiens
NVTLRESM

SEQ ID NO: 5685 - protein, 8 aa, Homo sapiens
FDPARFLD

SEQ ID NO: 5686 - protein, 8 aa, Homo sapiens
SSFVPVTI

SEQ ID NO: 5687 - protein, 8 aa, Homo sapiens
CESLRPGA

SEQ ID NO: 5688 - protein, 8 aa, Homo sapiens
DKFLRHCE

SEQ ID NO: 5689 - protein, 8 aa, Homo sapiens
VSGGRSMA

SEQ ID NO: 5690 - protein, 8 aa, Homo sapiens
SFRVVSGG

SEQ ID NO: 5691 - protein, 8 aa, Homo sapiens
VFQIRLGS

SEQ ID NO: 5692 - protein, 8 aa, Homo sapiens
RRQLRSAP

SEQ ID NO: 5693 - protein, 8 aa, Homo sapiens
QRLLRQRR

SEQ ID NO: 5694 - protein, 8 aa, Homo sapiens
HVGQRLLR

SEQ ID NO: 5695 - protein, 8 aa, Homo sapiens
ELLDSAVQ

SEQ ID NO: 5696 - protein, 8 aa, Homo sapiens
EPAKMNFS

SEQ ID NO: 5697 - protein, 8 aa, Homo sapiens
NPNEPAKM

SEQ ID NO: 5698 - protein, 8 aa, Homo sapiens
QCDFRANP

SEQ ID NO: 5699 - protein, 8 aa, Homo sapiens
SKMQLFLF

SEQ ID NO: 5700 - protein, 8 aa, Homo sapiens
ENFDPARF

SEQ ID NO: 5701 - protein, 8 aa, Homo sapiens
VLGYHIPK

SEQ ID NO: 5702 - protein, 8 aa, Homo sapiens
YEAMRFSS

SEQ ID NO: 5703 - protein, 8 aa, Homo sapiens
ELDQVVGR

SEQ ID NO: 5704 - protein, 8 aa, Homo sapiens
DVQTRVQA

SEQ ID NO: 5705 - protein, 8 aa, Homo sapiens
FTRYPDVQ

SEQ ID NO: 5706 - protein, 8 aa, Homo sapiens
SNFILDKF

SEQ ID NO: 5707 - protein, 8 aa, Homo sapiens
FEQLNRNF

SEQ ID NO: 5708 - protein, 8 aa, Homo sapiens
RTVFREFE

SEQ ID NO: 5709 - protein, 8 aa, Homo sapiens
VRTVFREF

SEQ ID NO: 5710 - protein, 8 aa, Homo sapiens
SLVDVMPW

SEQ ID NO: 5711 - protein, 8 aa, Homo sapiens
ELLSHNEE

SEQ ID NO: 5712 - protein, 8 aa, Homo sapiens
GCRYSHDD

SEQ ID NO: 5713 - protein, 8 aa, Homo sapiens
CFGCRYSH

SEQ ID NO: 5714 - protein, 8 aa, Homo sapiens
ELVALLVR

SEQ ID NO: 5715 - protein, 8 aa, Homo sapiens
LSEARELV

SEQ ID NO: 5716 - protein, 8 aa, Homo sapiens
TRQPRSRQ

SEQ ID NO: 5717 - protein, 8 aa, Homo sapiens
NFFTRQPR

SEQ ID NO: 5718 - protein, 8 aa, Homo sapiens
KVQRRAAH

SEQ ID NO: 5719 - protein, 8 aa, Homo sapiens
WKVQRRAA

SEQ ID NO: 5720 - protein, 8 aa, Homo sapiens
SGGRSMAF

SEQ ID NO: 5721 - protein, 8 aa, Homo sapiens
ARLARRYG

SEQ ID NO: 5722 - protein, 8 aa, Homo sapiens
LSFARLAR

SEQ ID NO: 5723 - protein, 8 aa, Homo sapiens
GQRLLRQR

SEQ ID NO: 5724 - protein, 8 aa, Homo sapiens
SLSPNDPW

SEQ ID NO: 5725 - protein, 8 aa, Homo sapiens
NFSYGLTI

SEQ ID NO: 5726 - protein, 8 aa, Homo sapiens
FLFISILA

SEQ ID NO: 5727 - protein, 8 aa, Homo sapiens
KMQLFLFI

SEQ ID NO: 5728 - protein, 8 aa, Homo sapiens
GKRRCIGE

SEQ ID NO: 5729 - protein, 8 aa, Homo sapiens
TSRVMIFS

SEQ ID NO: 5730 - protein, 8 aa, Homo sapiens
TSVLGYHI

SEQ ID NO: 5731 - protein, 8 aa, Homo sapiens
IPHATTAN

SEQ ID NO: 5732 - protein, 8 aa, Homo sapiens
VPVTIPHA

SEQ ID NO: 5733 - protein, 8 aa, Homo sapiens
VLAFLYEA

SEQ ID NO: 5734 - protein, 8 aa, Homo sapiens
RDRLPCMG

SEQ ID NO: 5735 - protein, 8 aa, Homo sapiens
YPDVQTRV

SEQ ID NO: 5736 - protein, 8 aa, Homo sapiens
LLLLFTRY

SEQ ID NO: 5737 - protein, 8 aa, Homo sapiens
WLLLLFTR

SEQ ID NO: 5738 - protein, 8 aa, Homo sapiens
LQWLLLLF

SEQ ID NO: 5739 - protein, 8 aa, Homo sapiens
LENVPATI

SEQ ID NO: 5740 - protein, 8 aa, Homo sapiens
RLDLENVP

SEQ ID NO: 5741 - protein, 8 aa, Homo sapiens
ILSAEKKA

SEQ ID NO: 5742 - protein, 8 aa, Homo sapiens
ILDKFLRH

SEQ ID NO: 5743 - protein, 8 aa, Homo sapiens
FPNPVRTV

SEQ ID NO: 5744 - protein, 8 aa, Homo sapiens
WLQYFPNP

SEQ ID NO: 5745 - protein, 8 aa, Homo sapiens
MPWLQYFP

SEQ ID NO: 5746 - protein, 8 aa, Homo sapiens
VMPWLQYF

SEQ ID NO: 5747 - protein, 8 aa, Homo sapiens
FGRTVGAG

SEQ ID NO: 5748 - protein, 8 aa, Homo sapiens
PLTVVAVA

SEQ ID NO: 5749 - protein, 8 aa, Homo sapiens
VLEGHVLS

SEQ ID NO: 5750 - protein, 8 aa, Homo sapiens
FTRQPRSR

SEQ ID NO: 5751 - protein, 8 aa, Homo sapiens
VQRRAAHS

SEQ ID NO: 5752 - protein, 8 aa, Homo sapiens
GGRSMAFG

SEQ ID NO: 5753 - protein, 8 aa, Homo sapiens
GERAIHQA

SEQ ID NO: 5754 - protein, 8 aa, Homo sapiens
CPIVVLNG

SEQ ID NO: 5755 - protein, 8 aa, Homo sapiens
IRLGSCPI

SEQ ID NO: 5756 - protein, 8 aa, Homo sapiens
HLSFARLA

SEQ ID NO: 5757 - protein, 8 aa, Homo sapiens
GQAAHLSF

SEQ ID NO: 5758 - protein, 8 aa, Homo sapiens
VLATVHVG

SEQ ID NO: 5759 - protein, 8 aa, Homo sapiens
LLSVLATV

SEQ ID NO: 5760 - protein, 8 aa, Homo sapiens
LLLLSVLA

SEQ ID NO: 5761 - protein, 8 aa, Homo sapiens
TLLLLLSV

SEQ ID NO: 5762 - protein, 8 aa, Homo sapiens
SAVQNLQA

SEQ ID NO: 5763 - protein, 8 aa, Homo sapiens
LLDSAVQN

SEQ ID NO: 5764 - protein, 8 aa, Homo sapiens
LTIKPKSF

SEQ ID NO: 5765 - protein, 8 aa, Homo sapiens
DFRANPNE

SEQ ID NO: 5766 - protein, 8 aa, Homo sapiens
SILAHQCD

SEQ ID NO: 5767 - protein, 8 aa, Homo sapiens
CIGEELSK

SEQ ID NO: 5768 - protein, 8 aa, Homo sapiens
KRRCIGEE

SEQ ID NO: 5769 - protein, 8 aa, Homo sapiens
LTSRVMIF

SEQ ID NO: 5770 - protein, 8 aa, Homo sapiens
DPARFLDK

SEQ ID NO: 5771 - protein, 8 aa, Homo sapiens
NPENFDPA

SEQ ID NO: 5772 - protein, 8 aa, Homo sapiens
WPNPENFD

SEQ ID NO: 5773 - protein, 8 aa, Homo sapiens
KWPNPENF

SEQ ID NO: 5774 - protein, 8 aa, Homo sapiens
DPLKWPNP

SEQ ID NO: 5775 - protein, 8 aa, Homo sapiens
AMRFSSFV

SEQ ID NO: 5776 - protein, 8 aa, Homo sapiens
LPCMGDQP

SEQ ID NO: 5777 - protein, 8 aa, Homo sapiens
RLPCMGDQ

SEQ ID NO: 5778 - protein, 8 aa, Homo sapiens
LLLFTRYP

SEQ ID NO: 5779 - protein, 8 aa, Homo sapiens
TLSTALQW

SEQ ID NO: 5780 - protein, 8 aa, Homo sapiens
DLENVPAT

SEQ ID NO: 5781 - protein, 8 aa, Homo sapiens
RDMMDAFI

SEQ ID NO: 5782 - protein, 8 aa, Homo sapiens
PRDMMDAF

SEQ ID NO: 5783 - protein, 8 aa, Homo sapiens
RPGAAPRD

SEQ ID NO: 5784 - protein, 8 aa, Homo sapiens
NRNFSNFI

SEQ ID NO: 5785 - protein, 8 aa, Homo sapiens
QLNRNFSN

SEQ ID NO: 5786 - protein, 8 aa, Homo sapiens
PVRTVFRE

SEQ ID NO: 5787 - protein, 8 aa, Homo sapiens
NPVRTVFR

SEQ ID NO: 5788 - protein, 8 aa, Homo sapiens
YSHDDPEF

SEQ ID NO: 5789 - protein, 8 aa, Homo sapiens
SAVCFGCR

SEQ ID NO: 5790 - protein, 8 aa, Homo sapiens
NVMSAVCF

SEQ ID NO: 5791 - protein, 8 aa, Homo sapiens
VANVMSAV

SEQ ID NO: 5792 - protein, 8 aa, Homo sapiens
RPLTVVAV

SEQ ID NO: 5793 - protein, 8 aa, Homo sapiens
GAFLDPRP

SEQ ID NO: 5794 - protein, 8 aa, Homo sapiens
SADGAFLD

SEQ ID NO: 5795 - protein, 8 aa, Homo sapiens
RGSADGAF

SEQ ID NO: 5796 - protein, 8 aa, Homo sapiens
LVRGSADG

SEQ ID NO: 5797 - protein, 8 aa, Homo sapiens
LLVRGSAD

SEQ ID NO: 5798 - protein, 8 aa, Homo sapiens
VALLVRGS

SEQ ID NO: 5799 - protein, 8 aa, Homo sapiens
RSRQVLEG

SEQ ID NO: 5800 - protein, 8 aa, Homo sapiens
MMRNFFTR

SEQ ID NO: 5801 - protein, 8 aa, Homo sapiens
AHSMMRNF

SEQ ID NO: 5802 - protein, 8 aa, Homo sapiens
QRRAAHSM

SEQ ID NO: 5803 - protein, 8 aa, Homo sapiens
RPAFASFR

SEQ ID NO: 5804 - protein, 8 aa, Homo sapiens
DRPAFASF

SEQ ID NO: 5805 - protein, 8 aa, Homo sapiens
ADRPAFAS

SEQ ID NO: 5806 - protein, 8 aa, Homo sapiens
SAFADRPA

SEQ ID NO: 5807 - protein, 8 aa, Homo sapiens
LVQQGSAF

SEQ ID NO: 5808 - protein, 8 aa, Homo sapiens
ALVQQGSA

SEQ ID NO: 5809 - protein, 8 aa, Homo sapiens
RLGSCPIV

SEQ ID NO: 5810 - protein, 8 aa, Homo sapiens
RYGDVFQI

SEQ ID NO: 5811 - protein, 8 aa, Homo sapiens
PLIGNAAA

SEQ ID NO: 5812 - protein, 8 aa, Homo sapiens
WPLIGNAA

SEQ ID NO: 5813 - protein, 8 aa, Homo sapiens
PPGPFAWP

SEQ ID NO: 5814 - protein, 8 aa, Homo sapiens
APPGPFAW

SEQ ID NO: 5815 - protein, 8 aa, Homo sapiens
SAPPGPFA

SEQ ID NO: 5816 - protein, 8 aa, Homo sapiens
RSAPPGPF

SEQ ID NO: 5817 - protein, 8 aa, Homo sapiens
RRRQLRSA

SEQ ID NO: 5818 - protein, 8 aa, Homo sapiens
QRRRQLRS

SEQ ID NO: 5819 - protein, 8 aa, Homo sapiens
RLLRQRRR

SEQ ID NO: 5820 - protein, 8 aa, Homo sapiens
LLLSVLAT

SEQ ID NO: 5821 - protein, 8 aa, Homo sapiens
PLSIQQTT

SEQ ID NO: 5822 - protein, 8 aa, Homo sapiens
NPLSIQQT

SEQ ID NO: 5823 - protein, 8 aa, Homo sapiens
PLNPLSIQ

SEQ ID NO: 5824 - protein, 8 aa, Homo sapiens
FISILAHQ

SEQ ID NO: 5825 - protein, 8 aa, Homo sapiens
HIPKDTVV

SEQ ID NO: 5826 - protein, 8 aa, Homo sapiens
HATTANTS

SEQ ID NO: 5827 - protein, 8 aa, Homo sapiens
LAFLYEAM

SEQ ID NO: 5828 - protein, 8 aa, Homo sapiens
QAELDQVV

SEQ ID NO: 5829 - protein, 8 aa, Homo sapiens
GASQDTLS

SEQ ID NO: 5830 - protein, 8 aa, Homo sapiens
FILSAEKK

SEQ ID NO: 5831 - protein, 8 aa, Homo sapiens
GAGSLVDV

SEQ ID NO: 5832 - protein, 8 aa, Homo sapiens
VAVANVMS

SEQ ID NO: 5833 - protein, 8 aa, Homo sapiens
FADRPAFA

SEQ ID NO: 5834 - protein, 8 aa, Homo sapiens
QALVQQGS

SEQ ID NO: 5835 - protein, 8 aa, Homo sapiens
PIVVLNGE

SEQ ID NO: 5836 - protein, 8 aa, Homo sapiens
AAHLSFAR

SEQ ID NO: 5837 - protein, 8 aa, Homo sapiens
AAAVGQAA

SEQ ID NO: 5838 - protein, 8 aa, Homo sapiens
FAWPLIGN

SEQ ID NO: 5839 - protein, 8 aa, Homo sapiens
LATVHVGQ

SEQ ID NO: 5840 - protein, 8 aa, Homo sapiens
ESMELLDS

SEQ ID NO: 5841 - protein, 8 aa, Homo sapiens
RANPNEPA

SEQ ID NO: 5842 - protein, 8 aa, Homo sapiens
LAHQCDFR

SEQ ID NO: 5843 - protein, 8 aa, Homo sapiens
MIFSVGKR

SEQ ID NO: 5844 - protein, 8 aa, Homo sapiens
LINKDLTS

SEQ ID NO: 5845 - protein, 8 aa, Homo sapiens
TANTSVLG

SEQ ID NO: 5846 - protein, 8 aa, Homo sapiens
TIPHATTA

SEQ ID NO: 5847 - protein, 8 aa, Homo sapiens
DIFGASQD

SEQ ID NO: 5848 - protein, 8 aa, Homo sapiens
TITDIFGA

SEQ ID NO: 5849 - protein, 8 aa, Homo sapiens
AAGDSHGG

SEQ ID NO: 5850 - protein, 8 aa, Homo sapiens
KAAGDSHG

SEQ ID NO: 5851 - protein, 8 aa, Homo sapiens
DAFILSAE

SEQ ID NO: 5852 - protein, 8 aa, Homo sapiens
AAPRDMMD

SEQ ID NO: 5853 - protein, 8 aa, Homo sapiens
SHNEEFGR

SEQ ID NO: 5854 - protein, 8 aa, Homo sapiens
AAHSMMRN

SEQ ID NO: 5855 - protein, 8 aa, Homo sapiens
RAAHSMMR

SEQ ID NO: 5856 - protein, 8 aa, Homo sapiens
MAFGHYSE

SEQ ID NO: 5857 - protein, 8 aa, Homo sapiens
PAFASFRV

SEQ ID NO: 5858 - protein, 8 aa, Homo sapiens
AIHQALVQ

SEQ ID NO: 5859 - protein, 8 aa, Homo sapiens
RAIHQALV

SEQ ID NO: 5860 - protein, 8 aa, Homo sapiens
QAAHLSFA

SEQ ID NO: 5861 - protein, 8 aa, Homo sapiens
AAVGQAAH

SEQ ID NO: 5862 - protein, 8 aa, Homo sapiens
NAAAVGQA

SEQ ID NO: 5863 - protein, 8 aa, Homo sapiens
LIGNAAAV

SEQ ID NO: 5864 - protein, 8 aa, Homo sapiens
SMELLDSA

SEQ ID NO: 5865 - protein, 8 aa, Homo sapiens
SYGLTIKP

SEQ ID NO: 5866 - protein, 8 aa, Homo sapiens
IGEELSKM

SEQ ID NO: 5867 - protein, 8 aa, Homo sapiens
VQAELDQV

SEQ ID NO: 5868 - protein, 8 aa, Homo sapiens
HNEEFGRT

SEQ ID NO: 5869 - protein, 8 aa, Homo sapiens
EGHVLSEA

SEQ ID NO: 5870 - protein, 8 aa, Homo sapiens
SRQVLEGH

SEQ ID NO: 5871 - protein, 8 aa, Homo sapiens
HYSEHWKV

SEQ ID NO: 5872 - protein, 8 aa, Homo sapiens
VQNLQAKE

SEQ ID NO: 5873 - protein, 8 aa, Homo sapiens
ISILAHQC

SEQ ID NO: 5874 - protein, 8 aa, Homo sapiens
GEELSKMQ

SEQ ID NO: 5875 - protein, 8 aa, Homo sapiens
IFSVGKRR

SEQ ID NO: 5876 - protein, 8 aa, Homo sapiens
SRVMIFSV

SEQ ID NO: 5877 - protein, 8 aa, Homo sapiens
PNPENFDP

SEQ ID NO: 5878 - protein, 8 aa, Homo sapiens
SVNHDPLK

SEQ ID NO: 5879 - protein, 8 aa, Homo sapiens
VVFVNQWS

SEQ ID NO: 5880 - protein, 8 aa, Homo sapiens
SVLGYHIP

SEQ ID NO: 5881 - protein, 8 aa, Homo sapiens
FVPVTIPH

SEQ ID NO: 5882 - protein, 8 aa, Homo sapiens
SFVPVTIP

SEQ ID NO: 5883 - protein, 8 aa, Homo sapiens
SQDTLSTA

SEQ ID NO: 5884 - protein, 8 aa, Homo sapiens
ENVPATIT

SEQ ID NO: 5885 - protein, 8 aa, Homo sapiens
LDLENVPA

SEQ ID NO: 5886 - protein, 8 aa, Homo sapiens
ESLRPGAA

SEQ ID NO: 5887 - protein, 8 aa, Homo sapiens
RHCESLRP

SEQ ID NO: 5888 - protein, 8 aa, Homo sapiens
EFEQLNRN

SEQ ID NO: 5889 - protein, 8 aa, Homo sapiens
REFEQLNR

SEQ ID NO: 5890 - protein, 8 aa, Homo sapiens
GSLVDVMP

SEQ ID NO: 5891 - protein, 8 aa, Homo sapiens
GRTVGAGS

SEQ ID NO: 5892 - protein, 8 aa, Homo sapiens
EFGRTVGA

SEQ ID NO: 5893 - protein, 8 aa, Homo sapiens
FRELLSHN

SEQ ID NO: 5894 - protein, 8 aa, Homo sapiens
SHDDPEFR

SEQ ID NO: 5895 - protein, 8 aa, Homo sapiens
VVAVANVM

SEQ ID NO: 5896 - protein, 8 aa, Homo sapiens
SEARELVA

SEQ ID NO: 5897 - protein, 8 aa, Homo sapiens
GHVLSEAR

SEQ ID NO: 5898 - protein, 8 aa, Homo sapiens
SMMRNFFT

SEQ ID NO: 5899 - protein, 8 aa, Homo sapiens
EHWKVQRR

SEQ ID NO: 5900 - protein, 8 aa, Homo sapiens
FGHYSEHW

SEQ ID NO: 5901 - protein, 8 aa, Homo sapiens
SMAFGHYS

SEQ ID NO: 5902 - protein, 8 aa, Homo sapiens
FRVVSGGR

SEQ ID NO: 5903 - protein, 8 aa, Homo sapiens
HQALVQQG

SEQ ID NO: 5904 - protein, 8 aa, Homo sapiens
IVVLNGER

SEQ ID NO: 5905 - protein, 8 aa, Homo sapiens
SCPIVVLN

SEQ ID NO: 5906 - protein, 8 aa, Homo sapiens
SFARLARR

SEQ ID NO: 5907 - protein, 8 aa, Homo sapiens
SVLATVHV

SEQ ID NO: 5908 - protein, 8 aa, Homo sapiens
GTSLSPND

SEQ ID NO: 5909 - protein, 8 aa, Homo sapiens
DSAVQNLQ

SEQ ID NO: 5910 - protein, 8 aa, Homo sapiens
MELLDSAV

SEQ ID NO: 5911 - protein, 8 aa, Homo sapiens
VTLRESME

SEQ ID NO: 5912 - protein, 8 aa, Homo sapiens
VNVTLRES

SEQ ID NO: 5913 - protein, 8 aa, Homo sapiens
KVNVTLRE

SEQ ID NO: 5914 - protein, 8 aa, Homo sapiens
FKVNVTLR

SEQ ID NO: 5915 - protein, 8 aa, Homo sapiens
IKPKSFKV

SEQ ID NO: 5916 - protein, 8 aa, Homo sapiens
FSYGLTIK

SEQ ID NO: 5917 - protein, 8 aa, Homo sapiens
FRANPNEP

SEQ ID NO: 5918 - protein, 8 aa, Homo sapiens
HQCDFRAN

SEQ ID NO: 5919 - protein, 8 aa, Homo sapiens
VMIFSVGK

SEQ ID NO: 5920 - protein, 8 aa, Homo sapiens
NKDLTSRV

SEQ ID NO: 5921 - protein, 8 aa, Homo sapiens
KDGLINKD

SEQ ID NO: 5922 - protein, 8 aa, Homo sapiens
ARFLDKDG

SEQ ID NO: 5923 - protein, 8 aa, Homo sapiens
VNHDPLKW

SEQ ID NO: 5924 - protein, 8 aa, Homo sapiens
QWSVNHDP

SEQ ID NO: 5925 - protein, 8 aa, Homo sapiens
VNQWSVNH

SEQ ID NO: 5926 - protein, 8 aa, Homo sapiens
FVNQWSVN

SEQ ID NO: 5927 - protein, 8 aa, Homo sapiens
VFVNQWSV

SEQ ID NO: 5928 - protein, 8 aa, Homo sapiens
DTVVFVNQ

SEQ ID NO: 5929 - protein, 8 aa, Homo sapiens
KDTVVFVN

SEQ ID NO: 5930 - protein, 8 aa, Homo sapiens
GYHIPKDT

SEQ ID NO: 5931 - protein, 8 aa, Homo sapiens
NTSVLGYH

SEQ ID NO: 5932 - protein, 8 aa, Homo sapiens
VTIPHATT

SEQ ID NO: 5933 - protein, 8 aa, Homo sapiens
FSSFVPVT

SEQ ID NO: 5934 - protein, 8 aa, Homo sapiens
AFLYEAMR

SEQ ID NO: 5935 - protein, 8 aa, Homo sapiens
PYVLAFLY

SEQ ID NO: 5936 - protein, 8 aa, Homo sapiens
GDQPNLPY

SEQ ID NO: 5937 - protein, 8 aa, Homo sapiens
GRDRLPCM

SEQ ID NO: 5938 - protein, 8 aa, Homo sapiens
VVGRDRLP

SEQ ID NO: 5939 - protein, 8 aa, Homo sapiens
DQVVGRDR

SEQ ID NO: 5940 - protein, 8 aa, Homo sapiens
LDQVVGRD

SEQ ID NO: 5941 - protein, 8 aa, Homo sapiens
VQTRVQAE

SEQ ID NO: 5942 - protein, 8 aa, Homo sapiens
QWLLLLFT

SEQ ID NO: 5943 - protein, 8 aa, Homo sapiens
IFGASQDT

SEQ ID NO: 5944 - protein, 8 aa, Homo sapiens
ITDIFGAS

SEQ ID NO: 5945 - protein, 8 aa, Homo sapiens
GGARLDLE

SEQ ID NO: 5946 - protein, 8 aa, Homo sapiens
HGGGARLD

SEQ ID NO: 5947 - protein, 8 aa, Homo sapiens
GDSHGGGA

SEQ ID NO: 5948 - protein, 8 aa, Homo sapiens
AFILSAEK

SEQ ID NO: 5949 - protein, 8 aa, Homo sapiens
HCESLRPG

SEQ ID NO: 5950 - protein, 8 aa, Homo sapiens
FSNFILDK

SEQ ID NO: 5951 - protein, 8 aa, Homo sapiens
FREFEQLN

SEQ ID NO: 5952 - protein, 8 aa, Homo sapiens
VDVMPWLQ

SEQ ID NO: 5953 - protein, 8 aa, Homo sapiens
AGSLVDVM

SEQ ID NO: 5954 - protein, 8 aa, Homo sapiens
VGAGSLVD

SEQ ID NO: 5955 - protein, 8 aa, Homo sapiens
RELLSHNE

SEQ ID NO: 5956 - protein, 8 aa, Homo sapiens
HDDPEFRE

SEQ ID NO: 5957 - protein, 8 aa, Homo sapiens
FGCRYSHD

SEQ ID NO: 5958 - protein, 8 aa, Homo sapiens
VCFGCRYS

SEQ ID NO: 5959 - protein, 8 aa, Homo sapiens
MSAVCFGC

SEQ ID NO: 5960 - protein, 8 aa, Homo sapiens
VMSAVCFG

SEQ ID NO: 5961 - protein, 8 aa, Homo sapiens
LTVVAVAN

SEQ ID NO: 5962 - protein, 8 aa, Homo sapiens
PRPLTVVA

SEQ ID NO: 5963 - protein, 8 aa, Homo sapiens
VRGSADGA

SEQ ID NO: 5964 - protein, 8 aa, Homo sapiens
LVALLVRG

SEQ ID NO: 5965 - protein, 8 aa, Homo sapiens
RELVALLV

SEQ ID NO: 5966 - protein, 8 aa, Homo sapiens
HVLSEARE

SEQ ID NO: 5967 - protein, 8 aa, Homo sapiens
RQVLEGHV

SEQ ID NO: 5968 - protein, 8 aa, Homo sapiens
FFTRQPRS

SEQ ID NO: 5969 - protein, 8 aa, Homo sapiens
GHYSEHWK

SEQ ID NO: 5970 - protein, 8 aa, Homo sapiens
GRSMAFGH

SEQ ID NO: 5971 - protein, 8 aa, Homo sapiens
VVSGGRSM

SEQ ID NO: 5972 - protein, 8 aa, Homo sapiens
GSAFADRP

SEQ ID NO: 5973 - protein, 8 aa, Homo sapiens
VQQGSAFA

SEQ ID NO: 5974 - protein, 8 aa, Homo sapiens
IHQALVQQ

SEQ ID NO: 5975 - protein, 8 aa, Homo sapiens
VVLNGERA

SEQ ID NO: 5976 - protein, 8 aa, Homo sapiens
FQIRLGSC

SEQ ID NO: 5977 - protein, 8 aa, Homo sapiens
YGDVFQIR

SEQ ID NO: 5978 - protein, 8 aa, Homo sapiens
VGQAAHLS

SEQ ID NO: 5979 - protein, 8 aa, Homo sapiens
GNAAAVGQ

SEQ ID NO: 5980 - protein, 8 aa, Homo sapiens
IGNAAAVG

SEQ ID NO: 5981 - protein, 8 aa, Homo sapiens
AWPLIGNA

SEQ ID NO: 5982 - protein, 8 aa, Homo sapiens
VGQRLLRQ

SEQ ID NO: 5983 - protein, 8 aa, Homo sapiens
LSVLATVH

SEQ ID NO: 5984 - protein, 8 aa, Homo sapiens
TTLLLLLS

SEQ ID NO: 5985 - protein, 8 aa, Homo sapiens
LNPLSIQQ

SEQ ID NO: 5986 - protein, 8 aa, Homo sapiens
PWPLNPLS

SEQ ID NO: 5987 - protein, 9 aa, Homo sapiens
LLRQRRRQL

SEQ ID NO: 5988 - protein, 9 aa, Homo sapiens
EARELVALL

SEQ ID NO: 5989 - protein, 9 aa, Homo sapiens
TLRESMELL

SEQ ID NO: 5990 - protein, 9 aa, Homo sapiens
TIKPKSFKV

SEQ ID NO: 5991 - protein, 9 aa, Homo sapiens
GLTIKPKSF

SEQ ID NO: 5992 - protein, 9 aa, Homo sapiens
DLTSRVMIF

SEQ ID NO: 5993 - protein, 9 aa, Homo sapiens
QPRSRQVLE

SEQ ID NO: 5994 - protein, 9 aa, Homo sapiens
VGKRRCIGE

SEQ ID NO: 5995 - protein, 9 aa, Homo sapiens
IPKDTVVFV

SEQ ID NO: 5996 - protein, 9 aa, Homo sapiens
APRDMMDAF

SEQ ID NO: 5997 - protein, 9 aa, Homo sapiens
QLFLFISIL

SEQ ID NO: 5998 - protein, 9 aa, Homo sapiens
ELSKMQLFL

SEQ ID NO: 5999 - protein, 9 aa, Homo sapiens
EELSKMQLF

SEQ ID NO: 6000 - protein, 9 aa, Homo sapiens
PLKWPNPEN

SEQ ID NO: 6001 - protein, 9 aa, Homo sapiens
SLVDVMPWL

SEQ ID NO: 6002 - protein, 9 aa, Homo sapiens
GERAIHQAL

SEQ ID NO: 6003 - protein, 9 aa, Homo sapiens
LLDSAVQNL

SEQ ID NO: 6004 - protein, 9 aa, Homo sapiens
KPKSFKVNV

SEQ ID NO: 6005 - protein, 9 aa, Homo sapiens
KRRCIGEEL

SEQ ID NO: 6006 - protein, 9 aa, Homo sapiens
FSVGKRRCI

SEQ ID NO: 6007 - protein, 9 aa, Homo sapiens
GLINKDLTS

SEQ ID NO: 6008 - protein, 9 aa, Homo sapiens
NLPYVLAFL

SEQ ID NO: 6009 - protein, 9 aa, Homo sapiens
QIRLGSCPI

SEQ ID NO: 6010 - protein, 9 aa, Homo sapiens
TLLLLLSVL

SEQ ID NO: 6011 - protein, 9 aa, Homo sapiens
NLQAKETCQ

SEQ ID NO: 6012 - protein, 9 aa, Homo sapiens
LSKMQLFLF

SEQ ID NO: 6013 - protein, 9 aa, Homo sapiens
RFLDKDGLI

SEQ ID NO: 6014 - protein, 9 aa, Homo sapiens
TLSTALQWL

SEQ ID NO: 6015 - protein, 9 aa, Homo sapiens
SAEKKAAGD

SEQ ID NO: 6016 - protein, 9 aa, Homo sapiens
ELLSHNEEF

SEQ ID NO: 6017 - protein, 9 aa, Homo sapiens
GAFLDPRPL

SEQ ID NO: 6018 - protein, 9 aa, Homo sapiens
ALLVRGSAD

SEQ ID NO: 6019 - protein, 9 aa, Homo sapiens
VSGGRSMAF

SEQ ID NO: 6020 - protein, 9 aa, Homo sapiens
LARRYGDVF

SEQ ID NO: 6021 - protein, 9 aa, Homo sapiens
PPGPFAWPL

SEQ ID NO: 6022 - protein, 9 aa, Homo sapiens
SIQQTTLLL

SEQ ID NO: 6023 - protein, 9 aa, Homo sapiens
PLSIQQTTL

SEQ ID NO: 6024 - protein, 9 aa, Homo sapiens
VGRDRLPCM

SEQ ID NO: 6025 - protein, 9 aa, Homo sapiens
FILDKFLRH

SEQ ID NO: 6026 - protein, 9 aa, Homo sapiens
FLDPRPLTV

SEQ ID NO: 6027 - protein, 9 aa, Homo sapiens
FASFRVVSG

SEQ ID NO: 6028 - protein, 9 aa, Homo sapiens
AAHLSFARL

SEQ ID NO: 6029 - protein, 9 aa, Homo sapiens
SFKVNVTLR

SEQ ID NO: 6030 - protein, 9 aa, Homo sapiens
PAKMNFSYG

SEQ ID NO: 6031 - protein, 9 aa, Homo sapiens
YEAMRFSSF

SEQ ID NO: 6032 - protein, 9 aa, Homo sapiens
LLFTRYPDV

SEQ ID NO: 6033 - protein, 9 aa, Homo sapiens
TALQWLLLL

SEQ ID NO: 6034 - protein, 9 aa, Homo sapiens
SLRPGAAPR

SEQ ID NO: 6035 - protein, 9 aa, Homo sapiens
DPEFRELLS

SEQ ID NO: 6036 - protein, 9 aa, Homo sapiens
SEARELVAL

SEQ ID NO: 6037 - protein, 9 aa, Homo sapiens
RLARRYGDV

SEQ ID NO: 6038 - protein, 9 aa, Homo sapiens
AAVGQAAHL

SEQ ID NO: 6039 - protein, 9 aa, Homo sapiens
RQRRRQLRS

SEQ ID NO: 6040 - protein, 9 aa, Homo sapiens
KDGLINKDL

SEQ ID NO: 6041 - protein, 9 aa, Homo sapiens
STALQWLLL

SEQ ID NO: 6042 - protein, 9 aa, Homo sapiens
SQDTLSTAL

SEQ ID NO: 6043 - protein, 9 aa, Homo sapiens
VPATITDIF

SEQ ID NO: 6044 - protein, 9 aa, Homo sapiens
LSAEKKAAG

SEQ ID NO: 6045 - protein, 9 aa, Homo sapiens
GAAPRDMMD

SEQ ID NO: 6046 - protein, 9 aa, Homo sapiens
FLRHCESLR

SEQ ID NO: 6047 - protein, 9 aa, Homo sapiens
SNFILDKFL

SEQ ID NO: 6048 - protein, 9 aa, Homo sapiens
PVRTVFREF

SEQ ID NO: 6049 - protein, 9 aa, Homo sapiens
FPNPVRTVF

SEQ ID NO: 6050 - protein, 9 aa, Homo sapiens
DPRPLTVVA

SEQ ID NO: 6051 - protein, 9 aa, Homo sapiens
HWKVQRRAA

SEQ ID NO: 6052 - protein, 9 aa, Homo sapiens
SEHWKVQRR

SEQ ID NO: 6053 - protein, 9 aa, Homo sapiens
SAFADRPAF

SEQ ID NO: 6054 - protein, 9 aa, Homo sapiens
ALVQQGSAF

SEQ ID NO: 6055 - protein, 9 aa, Homo sapiens
VTLRESMEL

SEQ ID NO: 6056 - protein, 9 aa, Homo sapiens
KSFKVNVTL

SEQ ID NO: 6057 - protein, 9 aa, Homo sapiens
SILAHQCDF

SEQ ID NO: 6058 - protein, 9 aa, Homo sapiens
GEELSKMQL

SEQ ID NO: 6059 - protein, 9 aa, Homo sapiens
ENFDPARFL

SEQ ID NO: 6060 - protein, 9 aa, Homo sapiens
HDPLKWPNP

SEQ ID NO: 6061 - protein, 9 aa, Homo sapiens
HIPKDTVVF

SEQ ID NO: 6062 - protein, 9 aa, Homo sapiens
VQTRVQAEL

SEQ ID NO: 6063 - protein, 9 aa, Homo sapiens
ALQWLLLLF

SEQ ID NO: 6064 - protein, 9 aa, Homo sapiens
DLENVPATI

SEQ ID NO: 6065 - protein, 9 aa, Homo sapiens
GARLDLENV

SEQ ID NO: 6066 - protein, 9 aa, Homo sapiens
EKKAAGDSH

SEQ ID NO: 6067 - protein, 9 aa, Homo sapiens
LNRNFSNFI

SEQ ID NO: 6068 - protein, 9 aa, Homo sapiens
QLNRNFSNF

SEQ ID NO: 6069 - protein, 9 aa, Homo sapiens
GRTVGAGSL

SEQ ID NO: 6070 - protein, 9 aa, Homo sapiens
DDPEFRELL

SEQ ID NO: 6071 - protein, 9 aa, Homo sapiens
HDDPEFREL

SEQ ID NO: 6072 - protein, 9 aa, Homo sapiens
HVLSEAREL

SEQ ID NO: 6073 - protein, 9 aa, Homo sapiens
ADRPAFASF

SEQ ID NO: 6074 - protein, 9 aa, Homo sapiens
LGSCPIVVL

SEQ ID NO: 6075 - protein, 9 aa, Homo sapiens
FARLARRYG

SEQ ID NO: 6076 - protein, 9 aa, Homo sapiens
QLRSAPPGP

SEQ ID NO: 6077 - protein, 9 aa, Homo sapiens
PKSFKVNVT

SEQ ID NO: 6078 - protein, 9 aa, Homo sapiens
INKDLTSRV

SEQ ID NO: 6079 - protein, 9 aa, Homo sapiens
ARFLDKDGL

SEQ ID NO: 6080 - protein, 9 aa, Homo sapiens
PARFLDKDG

SEQ ID NO: 6081 - protein, 9 aa, Homo sapiens
QWSVNHDPL

SEQ ID NO: 6082 - protein, 9 aa, Homo sapiens
DQVVGRDRL

SEQ ID NO: 6083 - protein, 9 aa, Homo sapiens
IFGASQDTL

SEQ ID NO: 6084 - protein, 9 aa, Homo sapiens
HGGGARLDL

SEQ ID NO: 6085 - protein, 9 aa, Homo sapiens
NRNFSNFIL

SEQ ID NO: 6086 - protein, 9 aa, Homo sapiens
EQLNRNFSN

SEQ ID NO: 6087 - protein, 9 aa, Homo sapiens
EEFGRTVGA

SEQ ID NO: 6088 - protein, 9 aa, Homo sapiens
RQVLEGHVL

SEQ ID NO: 6089 - protein, 9 aa, Homo sapiens
YGDVFQIRL

SEQ ID NO: 6090 - protein, 9 aa, Homo sapiens
TVHVGQRLL

SEQ ID NO: 6091 - protein, 9 aa, Homo sapiens
IQQTTLLLL

SEQ ID NO: 6092 - protein, 9 aa, Homo sapiens
AKMNFSYGL

SEQ ID NO: 6093 - protein, 9 aa, Homo sapiens
NEPAKMNFS

SEQ ID NO: 6094 - protein, 9 aa, Homo sapiens
SVGKRRCIG

SEQ ID NO: 6095 - protein, 9 aa, Homo sapiens
LDKDGLINK

SEQ ID NO: 6096 - protein, 9 aa, Homo sapiens
YHIPKDTVV

SEQ ID NO: 6097 - protein, 9 aa, Homo sapiens
ATTANTSVL

SEQ ID NO: 6098 - protein, 9 aa, Homo sapiens
DQPNLPYVL

SEQ ID NO: 6099 - protein, 9 aa, Homo sapiens
PCMGDQPNL

SEQ ID NO: 6100 - protein, 9 aa, Homo sapiens
DVQTRVQAE

SEQ ID NO: 6101 - protein, 9 aa, Homo sapiens
LSTALQWLL

SEQ ID NO: 6102 - protein, 9 aa, Homo sapiens
DSHGGGARL

SEQ ID NO: 6103 - protein, 9 aa, Homo sapiens
AEKKAAGDS

SEQ ID NO: 6104 - protein, 9 aa, Homo sapiens
RDMMDAFIL

SEQ ID NO: 6105 - protein, 9 aa, Homo sapiens
CESLRPGAA

SEQ ID NO: 6106 - protein, 9 aa, Homo sapiens
KFLRHCESL

SEQ ID NO: 6107 - protein, 9 aa, Homo sapiens
DKFLRHCES

SEQ ID NO: 6108 - protein, 9 aa, Homo sapiens
LDKFLRHCE

SEQ ID NO: 6109 - protein, 9 aa, Homo sapiens
TVFREFEQL

SEQ ID NO: 6110 - protein, 9 aa, Homo sapiens
PNPVRTVFR

SEQ ID NO: 6111 - protein, 9 aa, Homo sapiens
EFRELLSHN

SEQ ID NO: 6112 - protein, 9 aa, Homo sapiens
RGSADGAFL

SEQ ID NO: 6113 - protein, 9 aa, Homo sapiens
RQPRSRQVL

SEQ ID NO: 6114 - protein, 9 aa, Homo sapiens
HSMMRNFFT

SEQ ID NO: 6115 - protein, 9 aa, Homo sapiens
AAHSMMRNF

SEQ ID NO: 6116 - protein, 9 aa, Homo sapiens
LNGERAIHQ

SEQ ID NO: 6117 - protein, 9 aa, Homo sapiens
ATVHVGQRL

SEQ ID NO: 6118 - protein, 9 aa, Homo sapiens
QQTTLLLLL

SEQ ID NO: 6119 - protein, 9 aa, Homo sapiens
LSIQQTTLL

SEQ ID NO: 6120 - protein, 9 aa, Homo sapiens
NDPWPLNPL

SEQ ID NO: 6121 - protein, 9 aa, Homo sapiens
LSPNDPWPL

SEQ ID NO: 6122 - protein, 9 aa, Homo sapiens
ELLDSAVQN

SEQ ID NO: 6123 - protein, 9 aa, Homo sapiens
NVTLRESME

SEQ ID NO: 6124 - protein, 9 aa, Homo sapiens
EPAKMNFSY

SEQ ID NO: 6125 - protein, 9 aa, Homo sapiens
NPNEPAKMN

SEQ ID NO: 6126 - protein, 9 aa, Homo sapiens
FLFISILAH

SEQ ID NO: 6127 - protein, 9 aa, Homo sapiens
GKRRCIGEE

SEQ ID NO: 6128 - protein, 9 aa, Homo sapiens
FDPARFLDK

SEQ ID NO: 6129 - protein, 9 aa, Homo sapiens
VLGYHIPKD

SEQ ID NO: 6130 - protein, 9 aa, Homo sapiens
FLYEAMRFS

SEQ ID NO: 6131 - protein, 9 aa, Homo sapiens
ELDQVVGRD

SEQ ID NO: 6132 - protein, 9 aa, Homo sapiens
FTRYPDVQT

SEQ ID NO: 6133 - protein, 9 aa, Homo sapiens
RLDLENVPA

SEQ ID NO: 6134 - protein, 9 aa, Homo sapiens
GGGARLDLE

SEQ ID NO: 6135 - protein, 9 aa, Homo sapiens
ILSAEKKAA

SEQ ID NO: 6136 - protein, 9 aa, Homo sapiens
EFEQLNRNF

SEQ ID NO: 6137 - protein, 9 aa, Homo sapiens
VFREFEQLN

SEQ ID NO: 6138 - protein, 9 aa, Homo sapiens
RTVFREFEQ

SEQ ID NO: 6139 - protein, 9 aa, Homo sapiens
PLTVVAVAN

SEQ ID NO: 6140 - protein, 9 aa, Homo sapiens
ELVALLVRG

SEQ ID NO: 6141 - protein, 9 aa, Homo sapiens
VLSEARELV

SEQ ID NO: 6142 - protein, 9 aa, Homo sapiens
WKVQRRAAH

SEQ ID NO: 6143 - protein, 9 aa, Homo sapiens
SFRVVSGGR

SEQ ID NO: 6144 - protein, 9 aa, Homo sapiens
VFQIRLGSC

SEQ ID NO: 6145 - protein, 9 aa, Homo sapiens
RRQLRSAPP

SEQ ID NO: 6146 - protein, 9 aa, Homo sapiens
QRLLRQRRR

SEQ ID NO: 6147 - protein, 9 aa, Homo sapiens
HVGQRLLRQ

SEQ ID NO: 6148 - protein, 9 aa, Homo sapiens
LLLLSVLAT

SEQ ID NO: 6149 - protein, 9 aa, Homo sapiens
QCDFRANPN

SEQ ID NO: 6150 - protein, 9 aa, Homo sapiens
SKMQLFLFI

SEQ ID NO: 6151 - protein, 9 aa, Homo sapiens
TSRVMIFSV

SEQ ID NO: 6152 - protein, 9 aa, Homo sapiens
VPVTIPHAT

SEQ ID NO: 6153 - protein, 9 aa, Homo sapiens
FSSFVPVTI

SEQ ID NO: 6154 - protein, 9 aa, Homo sapiens
VLAFLYEAM

SEQ ID NO: 6155 - protein, 9 aa, Homo sapiens
PNLPYVLAF

SEQ ID NO: 6156 - protein, 9 aa, Homo sapiens
QPNLPYVLA

SEQ ID NO: 6157 - protein, 9 aa, Homo sapiens
QVVGRDRLP

SEQ ID NO: 6158 - protein, 9 aa, Homo sapiens
GCRYSHDDP

SEQ ID NO: 6159 - protein, 9 aa, Homo sapiens
CFGCRYSHD

SEQ ID NO: 6160 - protein, 9 aa, Homo sapiens
VRGSADGAF

SEQ ID NO: 6161 - protein, 9 aa, Homo sapiens
LSEARELVA

SEQ ID NO: 6162 - protein, 9 aa, Homo sapiens
VLEGHVLSE

SEQ ID NO: 6163 - protein, 9 aa, Homo sapiens
TRQPRSRQV

SEQ ID NO: 6164 - protein, 9 aa, Homo sapiens
NFFTRQPRS

SEQ ID NO: 6165 - protein, 9 aa, Homo sapiens
KVQRRAAHS

SEQ ID NO: 6166 - protein, 9 aa, Homo sapiens
AFADRPAFA

SEQ ID NO: 6167 - protein, 9 aa, Homo sapiens
VVLNGERAI

SEQ ID NO: 6168 - protein, 9 aa, Homo sapiens
ARRYGDVFQ

SEQ ID NO: 6169 - protein, 9 aa, Homo sapiens
ARLARRYGD

SEQ ID NO: 6170 - protein, 9 aa, Homo sapiens
LSFARLARR

SEQ ID NO: 6171 - protein, 9 aa, Homo sapiens
HLSFARLAR

SEQ ID NO: 6172 - protein, 9 aa, Homo sapiens
WPLIGNAAA

SEQ ID NO: 6173 - protein, 9 aa, Homo sapiens
LRQRRRQLR

SEQ ID NO: 6174 - protein, 9 aa, Homo sapiens
GQRLLRQRR

SEQ ID NO: 6175 - protein, 9 aa, Homo sapiens
VLATVHVGQ

SEQ ID NO: 6176 - protein, 9 aa, Homo sapiens
LLLLLSVLA

SEQ ID NO: 6177 - protein, 9 aa, Homo sapiens
SPNDPWPLN

SEQ ID NO: 6178 - protein, 9 aa, Homo sapiens
SLSPNDPWP

SEQ ID NO: 6179 - protein, 9 aa, Homo sapiens
SAVQNLQAK

SEQ ID NO: 6180 - protein, 9 aa, Homo sapiens
DFRANPNEP

SEQ ID NO: 6181 - protein, 9 aa, Homo sapiens
ILAHQCDFR

SEQ ID NO: 6182 - protein, 9 aa, Homo sapiens
KDLTSRVMI

SEQ ID NO: 6183 - protein, 9 aa, Homo sapiens
FLDKDGLIN

SEQ ID NO: 6184 - protein, 9 aa, Homo sapiens
NPENFDPAR

SEQ ID NO: 6185 - protein, 9 aa, Homo sapiens
WPNPENFDP

SEQ ID NO: 6186 - protein, 9 aa, Homo sapiens
NTSVLGYHI

SEQ ID NO: 6187 - protein, 9 aa, Homo sapiens
IPHATTANT

SEQ ID NO: 6188 - protein, 9 aa, Homo sapiens
AFLYEAMRF

SEQ ID NO: 6189 - protein, 9 aa, Homo sapiens
LPYVLAFLY

SEQ ID NO: 6190 - protein, 9 aa, Homo sapiens
RDRLPCMGD

SEQ ID NO: 6191 - protein, 9 aa, Homo sapiens
QTRVQAELD

SEQ ID NO: 6192 - protein, 9 aa, Homo sapiens
YPDVQTRVQ

SEQ ID NO: 6193 - protein, 9 aa, Homo sapiens
LLLLFTRYP

SEQ ID NO: 6194 - protein, 9 aa, Homo sapiens
WLLLLFTRY

SEQ ID NO: 6195 - protein, 9 aa, Homo sapiens
NVPATITDI

SEQ ID NO: 6196 - protein, 9 aa, Homo sapiens
ILDKFLRHC

SEQ ID NO: 6197 - protein, 9 aa, Homo sapiens
FSNFILDKF

SEQ ID NO: 6198 - protein, 9 aa, Homo sapiens
NPVRTVFRE

SEQ ID NO: 6199 - protein, 9 aa, Homo sapiens
WLQYFPNPV

SEQ ID NO: 6200 - protein, 9 aa, Homo sapiens
MPWLQYFPN

SEQ ID NO: 6201 - protein, 9 aa, Homo sapiens
FGRTVGAGS

SEQ ID NO: 6202 - protein, 9 aa, Homo sapiens
RYSHDDPEF

SEQ ID NO: 6203 - protein, 9 aa, Homo sapiens
ANVMSAVCF

SEQ ID NO: 6204 - protein, 9 aa, Homo sapiens
RPLTVVAVA

SEQ ID NO: 6205 - protein, 9 aa, Homo sapiens
FTRQPRSRQ

SEQ ID NO: 6206 - protein, 9 aa, Homo sapiens
VQRRAAHSM

SEQ ID NO: 6207 - protein, 9 aa, Homo sapiens
GGRSMAFGH

SEQ ID NO: 6208 - protein, 9 aa, Homo sapiens
VLNGERAIH

SEQ ID NO: 6209 - protein, 9 aa, Homo sapiens
PIVVLNGER

SEQ ID NO: 6210 - protein, 9 aa, Homo sapiens
CPIVVLNGE

SEQ ID NO: 6211 - protein, 9 aa, Homo sapiens
RRYGDVFQI

SEQ ID NO: 6212 - protein, 9 aa, Homo sapiens
VGQAAHLSF

SEQ ID NO: 6213 - protein, 9 aa, Homo sapiens
PLIGNAAAV

SEQ ID NO: 6214 - protein, 9 aa, Homo sapiens
GPFAWPLIG

SEQ ID NO: 6215 - protein, 9 aa, Homo sapiens
SAPPGPFAW

SEQ ID NO: 6216 - protein, 9 aa, Homo sapiens
RRRQLRSAP

SEQ ID NO: 6217 - protein, 9 aa, Homo sapiens
LLSVLATVH

SEQ ID NO: 6218 - protein, 9 aa, Homo sapiens
PWPLNPLSI

SEQ ID NO: 6219 - protein, 9 aa, Homo sapiens
DPWPLNPLS

SEQ ID NO: 6220 - protein, 9 aa, Homo sapiens
MNFSYGLTI

SEQ ID NO: 6221 - protein, 9 aa, Homo sapiens
PNEPAKMNF

SEQ ID NO: 6222 - protein, 9 aa, Homo sapiens
MQLFLFISI

SEQ ID NO: 6223 - protein, 9 aa, Homo sapiens
CIGEELSKM

SEQ ID NO: 6224 - protein, 9 aa, Homo sapiens
DPARFLDKD

SEQ ID NO: 6225 - protein, 9 aa, Homo sapiens
PENFDPARF

SEQ ID NO: 6226 - protein, 9 aa, Homo sapiens
LKWPNPENF

SEQ ID NO: 6227 - protein, 9 aa, Homo sapiens
DPLKWPNPE

SEQ ID NO: 6228 - protein, 9 aa, Homo sapiens
HATTANTSV

SEQ ID NO: 6229 - protein, 9 aa, Homo sapiens
AMRFSSFVP

SEQ ID NO: 6230 - protein, 9 aa, Homo sapiens
EAMRFSSFV

SEQ ID NO: 6231 - protein, 9 aa, Homo sapiens
LPCMGDQPN

SEQ ID NO: 6232 - protein, 9 aa, Homo sapiens
RLPCMGDQP

SEQ ID NO: 6233 - protein, 9 aa, Homo sapiens
QAELDQVVG

SEQ ID NO: 6234 - protein, 9 aa, Homo sapiens
LLLFTRYPD

SEQ ID NO: 6235 - protein, 9 aa, Homo sapiens
FILSAEKKA

SEQ ID NO: 6236 - protein, 9 aa, Homo sapiens
PRDMMDAFI

SEQ ID NO: 6237 - protein, 9 aa, Homo sapiens
RPGAAPRDM

SEQ ID NO: 6238 - protein, 9 aa, Homo sapiens
DVMPWLQYF

SEQ ID NO: 6239 - protein, 9 aa, Homo sapiens
GAGSLVDVM

SEQ ID NO: 6240 - protein, 9 aa, Homo sapiens
LLSHNEEFG

SEQ ID NO: 6241 - protein, 9 aa, Homo sapiens
SAVCFGCRY

SEQ ID NO: 6242 - protein, 9 aa, Homo sapiens
VANVMSAVC

SEQ ID NO: 6243 - protein, 9 aa, Homo sapiens
VAVANVMSA

SEQ ID NO: 6244 - protein, 9 aa, Homo sapiens
SADGAFLDP

SEQ ID NO: 6245 - protein, 9 aa, Homo sapiens
LVRGSADGA

SEQ ID NO: 6246 - protein, 9 aa, Homo sapiens
LLVRGSADG

SEQ ID NO: 6247 - protein, 9 aa, Homo sapiens
VALLVRGSA

SEQ ID NO: 6248 - protein, 9 aa, Homo sapiens
RSRQVLEGH

SEQ ID NO: 6249 - protein, 9 aa, Homo sapiens
MMRNFFTRQ

SEQ ID NO: 6250 - protein, 9 aa, Homo sapiens
AHSMMRNFF

SEQ ID NO: 6251 - protein, 9 aa, Homo sapiens
QRRAAHSMM

SEQ ID NO: 6252 - protein, 9 aa, Homo sapiens
RPAFASFRV

SEQ ID NO: 6253 - protein, 9 aa, Homo sapiens
FADRPAFAS

SEQ ID NO: 6254 - protein, 9 aa, Homo sapiens
RLGSCPIVV

SEQ ID NO: 6255 - protein, 9 aa, Homo sapiens
AAAVGQAAH

SEQ ID NO: 6256 - protein, 9 aa, Homo sapiens
FAWPLIGNA

SEQ ID NO: 6257 - protein, 9 aa, Homo sapiens
PGPFAWPLI

SEQ ID NO: 6258 - protein, 9 aa, Homo sapiens
APPGPFAWP

SEQ ID NO: 6259 - protein, 9 aa, Homo sapiens
LRSAPPGPF

SEQ ID NO: 6260 - protein, 9 aa, Homo sapiens
QRRRQLRSA

SEQ ID NO: 6261 - protein, 9 aa, Homo sapiens
RLLRQRRRQ

SEQ ID NO: 6262 - protein, 9 aa, Homo sapiens
LATVHVGQR

SEQ ID NO: 6263 - protein, 9 aa, Homo sapiens
LLLSVLATV

SEQ ID NO: 6264 - protein, 9 aa, Homo sapiens
NPLSIQQTT

SEQ ID NO: 6265 - protein, 9 aa, Homo sapiens
PLNPLSIQQ

SEQ ID NO: 6266 - protein, 9 aa, Homo sapiens
WPLNPLSIQ

SEQ ID NO: 6267 - protein, 9 aa, Homo sapiens
SYGLTIKPK

SEQ ID NO: 6268 - protein, 9 aa, Homo sapiens
RANPNEPAK

SEQ ID NO: 6269 - protein, 9 aa, Homo sapiens
FISILAHQC

SEQ ID NO: 6270 - protein, 9 aa, Homo sapiens
MIFSVGKRR

SEQ ID NO: 6271 - protein, 9 aa, Homo sapiens
TANTSVLGY

SEQ ID NO: 6272 - protein, 9 aa, Homo sapiens
TIPHATTAN

SEQ ID NO: 6273 - protein, 9 aa, Homo sapiens
LAFLYEAMR

SEQ ID NO: 6274 - protein, 9 aa, Homo sapiens
GASQDTLST

SEQ ID NO: 6275 - protein, 9 aa, Homo sapiens
TITDIFGAS

SEQ ID NO: 6276 - protein, 9 aa, Homo sapiens
DAFILSAEK

SEQ ID NO: 6277 - protein, 9 aa, Homo sapiens
MAFGHYSEH

SEQ ID NO: 6278 - protein, 9 aa, Homo sapiens
QALVQQGSA

SEQ ID NO: 6279 - protein, 9 aa, Homo sapiens
AIHQALVQQ

SEQ ID NO: 6280 - protein, 9 aa, Homo sapiens
QAAHLSFAR

SEQ ID NO: 6281 - protein, 9 aa, Homo sapiens
NAAAVGQAA

SEQ ID NO: 6282 - protein, 9 aa, Homo sapiens
VQNLQAKET

SEQ ID NO: 6283 - protein, 9 aa, Homo sapiens
SMELLDSAV

SEQ ID NO: 6284 - protein, 9 aa, Homo sapiens
ESMELLDSA

SEQ ID NO: 6285 - protein, 9 aa, Homo sapiens
LAHQCDFRA

SEQ ID NO: 6286 - protein, 9 aa, Homo sapiens
IGEELSKMQ

SEQ ID NO: 6287 - protein, 9 aa, Homo sapiens
LINKDLTSR

SEQ ID NO: 6288 - protein, 9 aa, Homo sapiens
SSFVPVTIP

SEQ ID NO: 6289 - protein, 9 aa, Homo sapiens
DIFGASQDT

SEQ ID NO: 6290 - protein, 9 aa, Homo sapiens
PATITDIFG

SEQ ID NO: 6291 - protein, 9 aa, Homo sapiens
LDLENVPAT

SEQ ID NO: 6292 - protein, 9 aa, Homo sapiens
AAGDSHGGG

SEQ ID NO: 6293 - protein, 9 aa, Homo sapiens
KAAGDSHGG

SEQ ID NO: 6294 - protein, 9 aa, Homo sapiens
AAPRDMMDA

SEQ ID NO: 6295 - protein, 9 aa, Homo sapiens
EFGRTVGAG

SEQ ID NO: 6296 - protein, 9 aa, Homo sapiens
SHNEEFGRT

SEQ ID NO: 6297 - protein, 9 aa, Homo sapiens
VVAVANVMS

SEQ ID NO: 6298 - protein, 9 aa, Homo sapiens
PRPLTVVAV

SEQ ID NO: 6299 - protein, 9 aa, Homo sapiens
EGHVLSEAR

SEQ ID NO: 6300 - protein, 9 aa, Homo sapiens
RAAHSMMRN

SEQ ID NO: 6301 - protein, 9 aa, Homo sapiens
HYSEHWKVQ

SEQ ID NO: 6302 - protein, 9 aa, Homo sapiens
PAFASFRVV

SEQ ID NO: 6303 - protein, 9 aa, Homo sapiens
RAIHQALVQ

SEQ ID NO: 6304 - protein, 9 aa, Homo sapiens
LIGNAAAVG

SEQ ID NO: 6305 - protein, 9 aa, Homo sapiens
FVPVTIPHA

SEQ ID NO: 6306 - protein, 9 aa, Homo sapiens
VQAELDQVV

SEQ ID NO: 6307 - protein, 9 aa, Homo sapiens
ESLRPGAAP

SEQ ID NO: 6308 - protein, 9 aa, Homo sapiens
GSLVDVMPW

SEQ ID NO: 6309 - protein, 9 aa, Homo sapiens
HNEEFGRTV

SEQ ID NO: 6310 - protein, 9 aa, Homo sapiens
QVLEGHVLS

SEQ ID NO: 6311 - protein, 9 aa, Homo sapiens
SRQVLEGHV

SEQ ID NO: 6312 - protein, 9 aa, Homo sapiens
SCPIVVLNG

SEQ ID NO: 6313 - protein, 9 aa, Homo sapiens
GSCPIVVLN

SEQ ID NO: 6314 - protein, 9 aa, Homo sapiens
SVLATVHVG

SEQ ID NO: 6315 - protein, 9 aa, Homo sapiens
DSAVQNLQA

SEQ ID NO: 6316 - protein, 9 aa, Homo sapiens
KVNVTLRES

SEQ ID NO: 6317 - protein, 9 aa, Homo sapiens
IKPKSFKVN

SEQ ID NO: 6318 - protein, 9 aa, Homo sapiens
FRANPNEPA

SEQ ID NO: 6319 - protein, 9 aa, Homo sapiens
ISILAHQCD

SEQ ID NO: 6320 - protein, 9 aa, Homo sapiens
IFSVGKRRC

SEQ ID NO: 6321 - protein, 9 aa, Homo sapiens
VMIFSVGKR

SEQ ID NO: 6322 - protein, 9 aa, Homo sapiens
SRVMIFSVG

SEQ ID NO: 6323 - protein, 9 aa, Homo sapiens
PNPENFDPA

SEQ ID NO: 6324 - protein, 9 aa, Homo sapiens
VNHDPLKWP

SEQ ID NO: 6325 - protein, 9 aa, Homo sapiens
SVNHDPLKW

SEQ ID NO: 6326 - protein, 9 aa, Homo sapiens
VNQWSVNHD

SEQ ID NO: 6327 - protein, 9 aa, Homo sapiens
FVNQWSVNH

SEQ ID NO: 6328 - protein, 9 aa, Homo sapiens
VVFVNQWSV

SEQ ID NO: 6329 - protein, 9 aa, Homo sapiens
DTVVFVNQW

SEQ ID NO: 6330 - protein, 9 aa, Homo sapiens
KDTVVFVNQ

SEQ ID NO: 6331 - protein, 9 aa, Homo sapiens
SVLGYHIPK

SEQ ID NO: 6332 - protein, 9 aa, Homo sapiens
SFVPVTIPH

SEQ ID NO: 6333 - protein, 9 aa, Homo sapiens
AELDQVVGR

SEQ ID NO: 6334 - protein, 9 aa, Homo sapiens
ENVPATITD

SEQ ID NO: 6335 - protein, 9 aa, Homo sapiens
GGARLDLEN

SEQ ID NO: 6336 - protein, 9 aa, Homo sapiens
SHGGGARLD

SEQ ID NO: 6337 - protein, 9 aa, Homo sapiens
GDSHGGGAR

SEQ ID NO: 6338 - protein, 9 aa, Homo sapiens
RHCESLRPG

SEQ ID NO: 6339 - protein, 9 aa, Homo sapiens
FEQLNRNFS

SEQ ID NO: 6340 - protein, 9 aa, Homo sapiens
REFEQLNRN

SEQ ID NO: 6341 - protein, 9 aa, Homo sapiens
VRTVFREFE

SEQ ID NO: 6342 - protein, 9 aa, Homo sapiens
AGSLVDVMP

SEQ ID NO: 6343 - protein, 9 aa, Homo sapiens
VGAGSLVDV

SEQ ID NO: 6344 - protein, 9 aa, Homo sapiens
RELLSHNEE

SEQ ID NO: 6345 - protein, 9 aa, Homo sapiens
FRELLSHNE

SEQ ID NO: 6346 - protein, 9 aa, Homo sapiens
SHDDPEFRE

SEQ ID NO: 6347 - protein, 9 aa, Homo sapiens
LTVVAVANV

SEQ ID NO: 6348 - protein, 9 aa, Homo sapiens
LVALLVRGS

SEQ ID NO: 6349 - protein, 9 aa, Homo sapiens
GHVLSEARE

SEQ ID NO: 6350 - protein, 9 aa, Homo sapiens
PRSRQVLEG

SEQ ID NO: 6351 - protein, 9 aa, Homo sapiens
SMMRNFFTR

SEQ ID NO: 6352 - protein, 9 aa, Homo sapiens
EHWKVQRRA

SEQ ID NO: 6353 - protein, 9 aa, Homo sapiens
FGHYSEHWK

SEQ ID NO: 6354 - protein, 9 aa, Homo sapiens
SMAFGHYSE

SEQ ID NO: 6355 - protein, 9 aa, Homo sapiens
SGGRSMAFG

SEQ ID NO: 6356 - protein, 9 aa, Homo sapiens
FRVVSGGRS

SEQ ID NO: 6357 - protein, 9 aa, Homo sapiens
VQQGSAFAD

SEQ ID NO: 6358 - protein, 9 aa, Homo sapiens
HQALVQQGS

SEQ ID NO: 6359 - protein, 9 aa, Homo sapiens
IHQALVQQG

SEQ ID NO: 6360 - protein, 9 aa, Homo sapiens
ERAIHQALV

SEQ ID NO: 6361 - protein, 9 aa, Homo sapiens
IVVLNGERA

SEQ ID NO: 6362 - protein, 9 aa, Homo sapiens
GDVFQIRLG

SEQ ID NO: 6363 - protein, 9 aa, Homo sapiens
SFARLARRY

SEQ ID NO: 6364 - protein, 9 aa, Homo sapiens
GNAAAVGQA

SEQ ID NO: 6365 - protein, 9 aa, Homo sapiens
IGNAAAVGQ

SEQ ID NO: 6366 - protein, 9 aa, Homo sapiens
AWPLIGNAA

SEQ ID NO: 6367 - protein, 9 aa, Homo sapiens
LSVLATVHV

SEQ ID NO: 6368 - protein, 9 aa, Homo sapiens
LNPLSIQQT

SEQ ID NO: 6369 - protein, 9 aa, Homo sapiens
GTSLSPNDP

SEQ ID NO: 6370 - protein, 9 aa, Homo sapiens
MELLDSAVQ

SEQ ID NO: 6371 - protein, 9 aa, Homo sapiens
VNVTLRESM

SEQ ID NO: 6372 - protein, 9 aa, Homo sapiens
FKVNVTLRE

SEQ ID NO: 6373 - protein, 9 aa, Homo sapiens
FSYGLTIKP

SEQ ID NO: 6374 - protein, 9 aa, Homo sapiens
NFSYGLTIK

SEQ ID NO: 6375 - protein, 9 aa, Homo sapiens
CDFRANPNE

SEQ ID NO: 6376 - protein, 9 aa, Homo sapiens
HQCDFRANP

SEQ ID NO: 6377 - protein, 9 aa, Homo sapiens
AHQCDFRAN

SEQ ID NO: 6378 - protein, 9 aa, Homo sapiens
KMQLFLFIS

SEQ ID NO: 6379 - protein, 9 aa, Homo sapiens
RVMIFSVGK

SEQ ID NO: 6380 - protein, 9 aa, Homo sapiens
NKDLTSRVM

SEQ ID NO: 6381 - protein, 9 aa, Homo sapiens
DKDGLINKD

SEQ ID NO: 6382 - protein, 9 aa, Homo sapiens
NQWSVNHDP

SEQ ID NO: 6383 - protein, 9 aa, Homo sapiens
VFVNQWSVN

SEQ ID NO: 6384 - protein, 9 aa, Homo sapiens
TVVFVNQWS

SEQ ID NO: 6385 - protein, 9 aa, Homo sapiens
PKDTVVFVN

SEQ ID NO: 6386 - protein, 9 aa, Homo sapiens
GYHIPKDTV

SEQ ID NO: 6387 - protein, 9 aa, Homo sapiens
LGYHIPKDT

SEQ ID NO: 6388 - protein, 9 aa, Homo sapiens
TSVLGYHIP

SEQ ID NO: 6389 - protein, 9 aa, Homo sapiens
TTANTSVLG

SEQ ID NO: 6390 - protein, 9 aa, Homo sapiens
VTIPHATTA

SEQ ID NO: 6391 - protein, 9 aa, Homo sapiens
RFSSFVPVT

SEQ ID NO: 6392 - protein, 9 aa, Homo sapiens
MRFSSFVPV

SEQ ID NO: 6393 - protein, 9 aa, Homo sapiens
YVLAFLYEA

SEQ ID NO: 6394 - protein, 9 aa, Homo sapiens
PYVLAFLYE

SEQ ID NO: 6395 - protein, 9 aa, Homo sapiens
GDQPNLPYV

SEQ ID NO: 6396 - protein, 9 aa, Homo sapiens
MGDQPNLPY

SEQ ID NO: 6397 - protein, 9 aa, Homo sapiens
GRDRLPCMG

SEQ ID NO: 6398 - protein, 9 aa, Homo sapiens
VVGRDRLPC

SEQ ID NO: 6399 - protein, 9 aa, Homo sapiens
LDQVVGRDR

SEQ ID NO: 6400 - protein, 9 aa, Homo sapiens
PDVQTRVQA

SEQ ID NO: 6401 - protein, 9 aa, Homo sapiens
TRYPDVQTR

SEQ ID NO: 6402 - protein, 9 aa, Homo sapiens
QWLLLLFTR

SEQ ID NO: 6403 - protein, 9 aa, Homo sapiens
LQWLLLLFT

SEQ ID NO: 6404 - protein, 9 aa, Homo sapiens
QDTLSTALQ

SEQ ID NO: 6405 - protein, 9 aa, Homo sapiens
FGASQDTLS

SEQ ID NO: 6406 - protein, 9 aa, Homo sapiens
ITDIFGASQ

SEQ ID NO: 6407 - protein, 9 aa, Homo sapiens
ATITDIFGA

SEQ ID NO: 6408 - protein, 9 aa, Homo sapiens
LENVPATIT

SEQ ID NO: 6409 - protein, 9 aa, Homo sapiens
AFILSAEKK

SEQ ID NO: 6410 - protein, 9 aa, Homo sapiens
MDAFILSAE

SEQ ID NO: 6411 - protein, 9 aa, Homo sapiens
MMDAFILSA

SEQ ID NO: 6412 - protein, 9 aa, Homo sapiens
HCESLRPGA

SEQ ID NO: 6413 - protein, 9 aa, Homo sapiens
NFILDKFLR

SEQ ID NO: 6414 - protein, 9 aa, Homo sapiens
NFSNFILDK

SEQ ID NO: 6415 - protein, 9 aa, Homo sapiens
FREFEQLNR

SEQ ID NO: 6416 - protein, 9 aa, Homo sapiens
YFPNPVRTV

SEQ ID NO: 6417 - protein, 9 aa, Homo sapiens
QYFPNPVRT

SEQ ID NO: 6418 - protein, 9 aa, Homo sapiens
LQYFPNPVR

SEQ ID NO: 6419 - protein, 9 aa, Homo sapiens
VMPWLQYFP

SEQ ID NO: 6420 - protein, 9 aa, Homo sapiens
VDVMPWLQY

SEQ ID NO: 6421 - protein, 9 aa, Homo sapiens
LVDVMPWLQ

SEQ ID NO: 6422 - protein, 9 aa, Homo sapiens
FGCRYSHDD

SEQ ID NO: 6423 - protein, 9 aa, Homo sapiens
VCFGCRYSH

SEQ ID NO: 6424 - protein, 9 aa, Homo sapiens
MSAVCFGCR

SEQ ID NO: 6425 - protein, 9 aa, Homo sapiens
VMSAVCFGC

SEQ ID NO: 6426 - protein, 9 aa, Homo sapiens
NVMSAVCFG

SEQ ID NO: 6427 - protein, 9 aa, Homo sapiens
AVANVMSAV

SEQ ID NO: 6428 - protein, 9 aa, Homo sapiens
GSADGAFLD

SEQ ID NO: 6429 - protein, 9 aa, Homo sapiens
RELVALLVR

SEQ ID NO: 6430 - protein, 9 aa, Homo sapiens
ARELVALLV

SEQ ID NO: 6431 - protein, 9 aa, Homo sapiens
LEGHVLSEA

SEQ ID NO: 6432 - protein, 9 aa, Homo sapiens
FFTRQPRSR

SEQ ID NO: 6433 - protein, 9 aa, Homo sapiens
YSEHWKVQR

SEQ ID NO: 6434 - protein, 9 aa, Homo sapiens
GHYSEHWKV

SEQ ID NO: 6435 - protein, 9 aa, Homo sapiens
GRSMAFGHY

SEQ ID NO: 6436 - protein, 9 aa, Homo sapiens
VVSGGRSMA

SEQ ID NO: 6437 - protein, 9 aa, Homo sapiens
ASFRVVSGG

SEQ ID NO: 6438 - protein, 9 aa, Homo sapiens
AFASFRVVS

SEQ ID NO: 6439 - protein, 9 aa, Homo sapiens
GSAFADRPA

SEQ ID NO: 6440 - protein, 9 aa, Homo sapiens
NGERAIHQA

SEQ ID NO: 6441 - protein, 9 aa, Homo sapiens
IRLGSCPIV

SEQ ID NO: 6442 - protein, 9 aa, Homo sapiens
FQIRLGSCP

SEQ ID NO: 6443 - protein, 9 aa, Homo sapiens
GQAAHLSFA

SEQ ID NO: 6444 - protein, 9 aa, Homo sapiens
VGQRLLRQR

SEQ ID NO: 6445 - protein, 9 aa, Homo sapiens
VHVGQRLLR

SEQ ID NO: 6446 - protein, 9 aa, Homo sapiens
TTLLLLLSV

SEQ ID NO: 6447 - protein, 9 aa, Homo sapiens
QTTLLLLLS

SEQ ID NO: 6448 - protein, 9 aa, Homo sapiens
TSLSPNDPW

SEQ ID NO: 6449 - protein, 9 aa, Homo sapiens
MGDQPNLPY

SEQ ID NO: 6450 - protein, 9 aa, Homo sapiens
YSEHWKVQR

SEQ ID NO: 6451 - protein, 10 aa, Homo sapiens
LVDVMPWLQY

SEQ ID NO: 6452 - protein, 10 aa, Homo sapiens
NFDPARFLDK

SEQ ID NO: 6453 - protein, 9 aa, Homo sapiens
RVMIFSVGK

SEQ ID NO: 6454 - protein, 9 aa, Homo sapiens
SVLGYHIPK

SEQ ID NO: 6455 - protein, 10 aa, Homo sapiens
RVMIFSVGKR

SEQ ID NO: 6456 - protein, 10 aa, Homo sapiens
GLTIKPKSFK

SEQ ID NO: 6457 - protein, 9 aa, Homo sapiens
WLQYFPNPV

SEQ ID NO: 6458 - protein, 9 aa, Homo sapiens
SLVDVMPWL

SEQ ID NO: 6459 - protein, 10 aa, Homo sapiens
LLLLSVLATV

SEQ ID NO: 6460 - protein, 10 aa, Homo sapiens
LLLFTRYPDV

SEQ ID NO: 6461 - protein, 9 aa, Homo sapiens
QLFLFISIL

SEQ ID NO: 6462 - protein, 9 aa, Homo sapiens
SLVDVMPWL

SEQ ID NO: 6463 - protein, 10 aa, Homo sapiens
MQLFLFISIL

SEQ ID NO: 6464 - protein, 10 aa, Homo sapiens
LLLLSVLATV

SEQ ID NO: 6465 - protein, 9 aa, Homo sapiens
SMMRNFFTR

SEQ ID NO: 6466 - protein, 9 aa, Homo sapiens
SVLGYHIPK

SEQ ID NO: 6467 - protein, 10 aa, Homo sapiens
GLTIKPKSFK

SEQ ID NO: 6468 - protein, 10 aa, Homo sapiens
FLDKDGLINK

SEQ ID NO: 6469 - protein, 9 aa, Homo sapiens
SMMRNFFTR

SEQ ID NO: 6470 - protein, 9 aa, Homo sapiens
VMIFSVGKR

SEQ ID NO: 6471 - protein, 10 aa, Homo sapiens
RVMIFSVGKR

SEQ ID NO: 6472 - protein, 10 aa, Homo sapiens
LQWLLLLFTR

SEQ ID NO: 6473 - protein, 9 aa, Homo sapiens
LSFARLARR

SEQ ID NO: 6474 - protein, 9 aa, Homo sapiens
LSHNEEFGR

SEQ ID NO: 6475 - protein, 10 aa, Homo sapiens
ESLRPGAAPR

SEQ ID NO: 6476 - protein, 10 aa, Homo sapiens
ELDQVVGRDR

SEQ ID NO: 6477 - protein, 9 aa, Homo sapiens
RYSHDDPEF

SEQ ID NO: 6478 - protein, 9 aa, Homo sapiens
KFLRHCESL

SEQ ID NO: 6479 - protein, 10 aa, Homo sapiens
RYGDVFQIRL

SEQ ID NO: 6480 - protein, 10 aa, Homo sapiens
LYEAMRFSSF

SEQ ID NO: 6481 - protein, 9 aa, Homo sapiens
SVLGYHIPK

SEQ ID NO: 6482 - protein, 9 aa, Homo sapiens
RVMIFSVGK

SEQ ID NO: 6483 - protein, 10 aa, Homo sapiens
RVMIFSVGKR

SEQ ID NO: 6484 - protein, 10 aa, Homo sapiens
HVGQRLLRQR

SEQ ID NO: 6485 - protein, 9 aa, Homo sapiens
EARELVALL

SEQ ID NO: 6486 - protein, 9 aa, Homo sapiens
LLRQRRRQL

SEQ ID NO: 6487 - protein, 10 aa, Homo sapiens
APPGPFAWPL

SEQ ID NO: 6488 - protein, 10 aa, Homo sapiens
APRDMMDAFI

SEQ ID NO: 6489 - protein, 9 aa, Homo sapiens
LLRQRRRQL

SEQ ID NO: 6490 - protein, 9 aa, Homo sapiens
EARELVALL

SEQ ID NO: 6491 - protein, 10 aa, Homo sapiens
FTRQPRSRQV

SEQ ID NO: 6492 - protein, 10 aa, Homo sapiens
KPKSFKVNVT

SEQ ID NO: 6493 - protein, 9 aa, Homo sapiens
ARFLDKDGL

SEQ ID NO: 6494 - protein, 9 aa, Homo sapiens
DQVVGRDRL

SEQ ID NO: 6495 - protein, 10 aa, Homo sapiens
RLLRQRRRQL

SEQ ID NO: 6496 - protein, 10 aa, Homo sapiens
ARLARRYGDV

SEQ ID NO: 6497 - protein, 9 aa, Homo sapiens
RRYGDVFQI

SEQ ID NO: 6498 - protein, 9 aa, Homo sapiens
ARFLDKDGL

SEQ ID NO: 6499 - protein, 10 aa, Homo sapiens
CRYSHDDPEF

SEQ ID NO: 6500 - protein, 10 aa, Homo sapiens
ARFLDKDGLI

SEQ ID NO: 6501 - protein, 9 aa, Homo sapiens
ARFLDKDGL

SEQ ID NO: 6502 - protein, 9 aa, Homo sapiens
RRYGDVFQI

SEQ ID NO: 6503 - protein, 10 aa, Homo sapiens
RRYGDVFQIR

SEQ ID NO: 6504 - protein, 10 aa, Homo sapiens
RRCIGEELSK

SEQ ID NO: 6505 - protein, 9 aa, Homo sapiens
EEFGRTVGA

SEQ ID NO: 6506 - protein, 9 aa, Homo sapiens
SEARELVAL

SEQ ID NO: 6507 - protein, 10 aa, Homo sapiens
EELSKMQLFL

SEQ ID NO: 6508 - protein, 10 aa, Homo sapiens
SEARELVALL

SEQ ID NO: 6509 - protein, 9 aa, Homo sapiens
SEARELVAL

SEQ ID NO: 6510 - protein, 9 aa, Homo sapiens
GEELSKMQL

SEQ ID NO: 6511 - protein, 10 aa, Homo sapiens
EELSKMQLFL

SEQ ID NO: 6512 - protein, 10 aa, Homo sapiens
SEARELVALL

SEQ ID NO: 6513 - protein, 9 aa, Homo sapiens
EEFGRTVGA

SEQ ID NO: 6514 - protein, 9 aa, Homo sapiens
CESLRPGAA

SEQ ID NO: 6515 - protein, 10 aa, Homo sapiens
QLRSAPPGPF

SEQ ID NO: 6516 - protein, 10 aa, Homo sapiens
NLPYVLAFLY

SEQ ID NO: 6517 - protein, 9 aa, Homo sapiens
ALQWLLLLF

SEQ ID NO: 6518 - protein, 9 aa, Homo sapiens
WLLLLFTRY

SEQ ID NO: 6519 - protein, 10 aa, Homo sapiens
QLRSAPPGPF

SEQ ID NO: 6520 - protein, 10 aa, Homo sapiens
NLPYVLAFLY

SEQ ID NO: 6521 - protein, 9 aa, Homo sapiens
APRDMMDAF

SEQ ID NO: 6522 - protein, 9 aa, Homo sapiens
RPGAAPRDM

SEQ ID NO: 6523 - protein, 10 aa, Homo sapiens
RPGAAPRDMM

SEQ ID NO: 6524 - protein, 10 aa, Homo sapiens
APRDMMDAFI

SEQ ID NO: 6525 - protein, 9 aa, Homo sapiens
DDPEFRELL

SEQ ID NO: 6526 - protein, 9 aa, Homo sapiens
KDLTSRVMI

SEQ ID NO: 6527 - protein, 9 aa, Homo sapiens
AHSMMRNFF

SEQ ID NO: 6528 - protein, 9 aa, Homo sapiens
NHDPLKWPN

SEQ ID NO: 6529 - protein, 9 aa, Homo sapiens
AHSMMRNFF

SEQ ID NO: 6530 - protein, 9 aa, Homo sapiens
NHDPLKWPN

SEQ ID NO: 6531 - protein, 9 aa, Homo sapiens
AHSMMRNFF

SEQ ID NO: 6532 - protein, 9 aa, Homo sapiens
NHDPLKWPN

SEQ ID NO: 6533 - protein, 9 aa, Homo sapiens
GHYSEHWKV

SEQ ID NO: 6534 - protein, 9 aa, Homo sapiens
YHIPKDTVV

SEQ ID NO: 6535 - protein, 10 aa, Homo sapiens
SHDDPEFREL

SEQ ID NO: 6536 - protein, 10 aa, Homo sapiens
GHVLSEAREL

SEQ ID NO: 6537 - protein, 9 aa, Homo sapiens
QQTTLLLLL

SEQ ID NO: 6538 - protein, 9 aa, Homo sapiens
DQPNLPYVL

SEQ ID NO: 6539 - protein, 10 aa, Homo sapiens
DKDGLINKDL

SEQ ID NO: 6540 - protein, 10 aa, Homo sapiens
MQLFLFISIL

SEQ ID NO: 6541 - protein, 9 aa, Homo sapiens
EELSKMQLF

SEQ ID NO: 6542 - protein, 9 aa, Homo sapiens
YEAMRFSSF

SEQ ID NO: 6543 - protein, 10 aa, Homo sapiens
NEPAKMNFSY

SEQ ID NO: 6544 - protein, 10 aa, Homo sapiens
RELLSHNEEF

SEQ ID NO: 6545 - protein, 9 aa, Homo sapiens
IPKDTVVFV

SEQ ID NO: 6546 - protein, 9 aa, Homo sapiens
EAMRFSSFV

SEQ ID NO: 6547 - protein, 10 aa, Homo sapiens
DPWPLNPLSI

SEQ ID NO: 6548 - protein, 10 aa, Homo sapiens
APRDMMDAFI

SEQ ID NO: 6549 - protein, 9 aa, Homo sapiens
RPAFASFRV

SEQ ID NO: 6550 - protein, 9 aa, Homo sapiens
GAFLDPRPL

SEQ ID NO: 6551 - protein, 10 aa, Homo sapiens
DPWPLNPLSI

SEQ ID NO: 6552 - protein, 10 aa, Homo sapiens
WPLIGNAAAV

SEQ ID NO: 6553 - protein, 9 aa, Homo sapiens
HATTANTSV

SEQ ID NO: 6554 - protein, 9 aa, Homo sapiens
EAMRFSSFV

SEQ ID NO: 6555 - protein, 10 aa, Homo sapiens
LGYHIPKDTV

SEQ ID NO: 6556 - protein, 10 aa, Homo sapiens
VAVANVMSAV

SEQ ID NO: 6557 - protein, 9 aa, Homo sapiens
VQAELDQVV

SEQ ID NO: 6558 - protein, 9 aa, Homo sapiens
DQPNLPYVL

SEQ ID NO: 6559 - protein, 10 aa, Homo sapiens
MQLFLFISIL

SEQ ID NO: 6560 - protein, 10 aa, Homo sapiens
RPAFASFRVV

SEQ ID NO: 6561 - protein, 9 aa, Homo sapiens
GSLVDVMPW

SEQ ID NO: 6562 - protein, 9 aa, Homo sapiens
SAPPGPFAW

SEQ ID NO: 6563 - protein, 10 aa, Homo sapiens
RSAPPGPFAW

SEQ ID NO: 6564 - protein, 10 aa, Homo sapiens
RAAHSMMRNF

What is claimed is:

1. A purified cytochrome P450 1B1 peptide that binds to a major histocompatibility complex molecule, wherein said peptide consists of CYP190 (SEQ ID NO:3).

* * * * *